US011987791B2

(12) United States Patent
Smith et al.

(10) Patent No.: US 11,987,791 B2
(45) Date of Patent: May 21, 2024

(54) COMPOSITIONS AND METHODS FOR MODULATING HEPATOCYTE NUCLEAR FACTOR 4-ALPHA (HNF4α) GENE EXPRESSION

(71) Applicant: Omega Therapeutics, Inc., Cambridge, MA (US)

(72) Inventors: Jesse Jerome Smith, Waltham, MA (US); Jodi Michelle Kennedy, Dedham, MA (US); Jeremiah D. Farelli, Marblehead, MA (US); Kendrick Alan Goss, Lexington, MA (US); Adam Walter Scheidegger, Somerville, MA (US); Yoseph Kassa, Cambridge, MA (US); Christian Wessel Cobaugh, Newton, MA (US); Timsi Rao, Allston, MA (US)

(73) Assignee: Omega Therapeutics, Inc., Cambridge, MA (US)

(*) Notice: Subject to any disclaimer, the term of this patent is extended or adjusted under 35 U.S.C. 154(b) by 427 days.

(21) Appl. No.: 17/029,820

(22) Filed: Sep. 23, 2020

(65) Prior Publication Data
US 2022/0348908 A1 Nov. 3, 2022

Related U.S. Application Data

(60) Provisional application No. 62/904,178, filed on Sep. 23, 2019.

(51) Int. Cl.
C12N 15/11 (2006.01)
A61P 1/16 (2006.01)
C07K 14/47 (2006.01)
C12N 9/22 (2006.01)
C12N 15/63 (2006.01)

(52) U.S. Cl.
CPC ............... C12N 15/11 (2013.01); C12N 9/22 (2013.01); C07K 2319/80 (2013.01); C07K 2319/81 (2013.01); C12N 2310/20 (2017.05)

(58) Field of Classification Search
None
See application file for complete search history.

(56) References Cited

U.S. PATENT DOCUMENTS

| 8,513,207 | B2 | 8/2013 | Brown |
| 11,624,065 | B2 | 4/2023 | Lande et al. |
| 2012/0115227 | A1 | 5/2012 | Cohen-Haguenauer et al. |
| 2014/0273226 | A1 | 9/2014 | Wu |
| 2014/0322707 | A1 | 10/2014 | He et al. |
| 2015/0071906 | A1 | 3/2015 | Liu et al. |
| 2015/0376612 | A1 | 12/2015 | Lee et al. |
| 2016/0010076 | A1 | 1/2016 | Joung et al. |
| 2016/0024474 | A1 | 1/2016 | Conway et al. |
| 2016/0186208 | A1 | 6/2016 | Jaenisch et al. |
| 2016/0215280 | A1 | 7/2016 | Fanucchi et al. |
| 2016/0340749 | A1 | 11/2016 | Stelzer et al. |
| 2017/0014449 | A1 | 1/2017 | Bangera et al. |
| 2017/0130247 | A1 | 5/2017 | Dowen et al. |
| 2017/0362649 | A1 | 12/2017 | Lieberman-Aiden et al. |
| 2018/0245079 | A1 | 8/2018 | Lieberman Aiden et al. |
| 2019/0241964 | A1 | 8/2019 | Hunter et al. |
| 2019/0309291 | A1 | 10/2019 | Lee et al. |
| 2019/0359959 | A1 | 11/2019 | Jaenisch et al. |
| 2020/0224274 | A1 | 7/2020 | Bernstein et al. |
| 2020/0255828 | A1 | 8/2020 | Aiden et al. |
| 2022/0288237 | A1 | 9/2022 | Patil et al. |
| 2023/0114151 | A1 | 4/2023 | Rao et al. |

FOREIGN PATENT DOCUMENTS

| CN | 108949794 A | 12/2018 |
| CN | 109929865 A | 6/2019 |
| WO | 2003/016496 A2 | 2/2003 |
| WO | WO-2006/053430 A1 | 5/2006 |
| WO | 2008/006028 A2 | 1/2008 |
| WO | WO-2012/019168 A2 | 2/2012 |
| WO | WO-2012/061698 A2 | 5/2012 |
| WO | WO-2014/204726 A1 | 12/2014 |
| WO | WO-2015/038892 A1 | 3/2015 |
| WO | WO-2015/162422 A1 | 10/2015 |
| WO | WO-2015/191780 A2 | 12/2015 |
| WO | WO-2015/196128 A2 | 12/2015 |
| WO | WO-2016/022363 A2 | 2/2016 |
| WO | WO-2016/063264 A1 | 4/2016 |
| WO | WO-2016/070037 A2 | 5/2016 |
| WO | WO-2016/073990 A2 | 5/2016 |
| WO | WO-2016/081798 A1 | 5/2016 |

(Continued)

OTHER PUBLICATIONS

Babeu et al. (P1 promoter-driven HNF4α isoforms are specifically repressed by β-catenin signaling in colorectal cancer cells, J Cell Sci (2018) 131 (13) pp. 1-13, published on Jul. 6, 2018).*
Zhang et al. (Generate TALE/TALEN as Easily and Rapidly as Generating CRISPR, Molecular Therapy: Methods & Clinical Development, vol. 13, published Jun. 2019, pp. 310-320).*
Invitation to Pay Additional Fees and, where Applicable, Protest Fee for Application No. PCT/US2020/052275, dated Dec. 11, 2020, 18 pages.
International Search Report and Written Opinion for Application No. PCT/US2020/052275, dated Feb. 26, 2021, 27 pages.
U.S. Appl. No. 17/701,325, filed Mar. 22, 2022, 2022-0288237, Published.
U.S. Appl. No. 17/929,828, filed Sep. 6, 2022, 2023-0114151, Published.

(Continued)

Primary Examiner — Suzanne M Noakes
Assistant Examiner — Jae W Lee
(74) Attorney, Agent, or Firm — McCarter & English, LLP; Maria Laccotripe Zacharakis; Maneesh Gulati

(57) ABSTRACT

The present invention provides agents and compositions for modulating expression (e.g., enhanced or reduced expression) of a hepatocyte nuclear factor 4 alpha (HNF4α) gene by targeting an HNF4α expression control region and methods of use thereof for treating an HNF4α associated disorder, e.g., cirrhosis.

37 Claims, 25 Drawing Sheets

Specification includes a Sequence Listing.

(56) References Cited

FOREIGN PATENT DOCUMENTS

| | | |
|---|---|---|
| WO | WO-2016/103233 A2 | 6/2016 |
| WO | WO-2016/115326 A1 | 7/2016 |
| WO | WO-2016/154330 A1 | 9/2016 |
| WO | WO-2016/164356 A1 | 10/2016 |
| WO | WO-2016/174250 A1 | 11/2016 |
| WO | WO-2017/011710 A2 | 1/2017 |
| WO | WO-2017/031370 A1 | 2/2017 |
| WO | WO-2017/040793 A1 | 3/2017 |
| WO | WO-2017/064546 A1 | 4/2017 |
| WO | WO-2017/106290 A1 | 6/2017 |
| WO | WO-2017/143042 A2 | 8/2017 |
| WO | 2018/020012 A1 | 2/2018 |
| WO | WO-2018/031762 A1 | 2/2018 |
| WO | WO-2018/035495 A1 | 2/2018 |
| WO | WO-2018/049073 A1 | 3/2018 |
| WO | WO-2018/049075 A1 | 3/2018 |
| WO | WO-2018/049077 A1 | 3/2018 |
| WO | WO-2018/049079 A1 | 3/2018 |
| WO | WO-2018/111944 A1 | 6/2018 |
| WO | WO-2018/129544 A1 | 7/2018 |
| WO | WO-2018/204764 A1 | 11/2018 |
| WO | WO-2019/04863 A1 | 1/2019 |
| WO | WO-2019/036430 A1 | 2/2019 |
| WO | 2019/048631 A1 | 3/2019 |
| WO | WO-2019/071054 A1 | 4/2019 |
| WO | 2019/109051 A1 | 6/2019 |
| WO | WO-2021/061698 A1 | 4/2021 |

OTHER PUBLICATIONS

U.S. Appl. No. 15/821,632, filed Nov. 22, 2017, U.S. Pat. No. 11,312,955, Issued.
U.S. Appl. No. 16/155,688, filed Oct. 9, 2018, U.S. Pat. No. 11,624,065, Issued.
U.S. Appl. No. 16/330,999, filed Mar. 6, 2019, 2019-0255106, Abandoned.
U.S. Appl. No. 17/698,917, filed Mar. 18, 2022, 2023-0054672, Published.
Amabile et al., Inheritable Silencing of Endogenous Genes by Hit-and-Run Targeted Epigenetic Editing. Cell. Sep. 22, 2016;167(1):219-232.e14.
Banani et al., Biomolecular condensates: organizers of cellular biochemistry. Nat Rev Mol Cell Biol. May 2017;18(5):285-298.
Cho et al., Antisense transcription and heterochromatin at the DM1 CTG repeats are constrained by CTCF. Mol Cell. Nov. 11, 2005;20(3):483-9.
Cong et al., Multiplex genome engineering using CRISPR/Cas systems. Science. Feb. 15, 2013;339(6121):819-23.
De Groote et al., Epigenetic Editing: targeted rewriting of epigenetic marks to modulate expression of selected target genes. Nucleic Acids Res. Nov. 2012;40(21):10596-613.
De Souza et al., DNA methylation profiling in human Huntington's disease brain. Human Molecular Genetics. May 15, 2016;25(10):2013-2030.
De Wit et al., CTCF Binding Polarity Determines Chromatin Looping. Mol Cell. Nov. 19, 2015;60(4):676-84.
Deng et al., Controlling long-range genomic interactions at a native locus by targeted tethering of a looping factor. Cell. Jun. 8, 2012;149(6):1233-44.
Dunham et al., An integrated encyclopedia of DNA elements in the human genome. Nature. Sep. 6, 2012;489(7414):57-74.
Ecker et al., Genomics: ENCODE explained. Nature. Sep. 6, 2012;489(7414):52-5.
Flavahan et al., Insulator dysfunction and oncogene activation in IDH mutant gliomas. Nature. Jan. 7, 2016;529(7584):110-4.
Forstneric et al., CRISPRa-mediated FOXP3 gene upregulation in mammalian cells. Cell Biosci. Nov. 21, 2019;9:93, 12 pages.
Georgiev et al., Regulatory T Cells: the Many Faces of Foxp3. J Clin Immunol. Oct. 2019;39(7):623-640.

Guo et al., YY1TargetDB: an integral information resource for Yin Yang 1 target loci. Database (Oxford). Feb. 1, 20134;2013:bat007, 10 pages.
Herold et al., CTCF: insights into insulator function during development. Development. Mar. 2012;139(6):1045-57.
Hsu, Completion of a Programmable DNA-Binding Small Molecule Library. Thesis in Partial Fulfillment of the Requirements for the Degree of Doctor of Philosophy. California Institute of Technology. 153 pages, (2009).
Jarrett et al., Somatic genome editing with CRISPR/Cas9 generates and corrects a metabolic disease. Sci Rep. Mar. 16, 2017;7:44624, 12 pages.
Jeffries, Epigenetic editing: How cutting-edge targeted epigenetic modification might provide novel avenues for autoimmune disease therapy. Clin Immunol. Nov. 2018;196:49-58.
Jia et al., The expression of FOXP3 and its role in human cancers. Biochim Biophys Acta Rev Cancer. Jan. 2019;1871(1):170-178.
Jinek et al., A programmable dual-RNA-guided DNA endonuclease in adaptive bacterial immunity. Science. Aug. 17, 2012;337(6096):816-21.
Karl et al., Recruitment of Histone Methyltransferase Ehmt1 to Foxp3 TSDR Counteracts Differentiation of Induced Regulatory T Cells. J Mol Biol. Sep. 6, 2019;431(19):3606-3625.
Kearns et al., Functional annotation of native enhancers with a Cas9-histone demethylase fusion. Nat Methods. May 2015;12(5):401-403.
Kim et al., Genome-wide target specificities of CRISPR RNA-guided programmable deaminases. Nat Biotechnol. May 2017;35(5):475-480.
Koferle et al., Brave new epigenomes: the dawn of epigenetic engineering. Genome Med. Jun. 19, 2015;7(1):59, 3 pages.
Komor et al., Programmable editing of a target base in genomic DNA without double-stranded DNA cleavage. Nature. May 19, 2016;533(7603):420-4.
Krylov et al., A general method to design dominant negatives to B-HLHZip proteins that abolish DNA binding. Proc Natl Acad Sci U S A. Nov. 11, 1997;94(23):12274-9.
Lei et al., Targeted DNA methylation in vivo using an engineered dCas9-MQ1 fusion protein. Nature Communications. 2017;16026:1-10.
Li et al., An alternative CTCF isoform antagonizes canonical CTCF occupancy and changes chromatin architecture to promote apoptosis. Nat Commun. Apr. 4, 2019;10(1):1535, 13 pages.
Lin et al., Formation and Maturation of Phase-Separated Liquid Droplets by RNA-Binding Proteins. Mol Cell. Oct. 15, 2015;60(2):208-19.
Ling et al., Long-range DNA interactions are specifically altered by locked nucleic acid-targeting of a CTCF binding site. Biochim Biophys Acta. Jan. 2011;1809(1):24-33.
Liu et al., Editing DNA Methylation in the Mammalian Genome. Cell. Sep. 22, 2016;167(1):233-247.e17.
Ma et al., Targeted gene suppression by inducing de novo DNA methylation in the gene promoter. Epigenetics Chromatin. Aug. 18, 2014;7:20, 11 pages.
Maruyama et al., The molecular mechanisms of Foxp3 gene regulation. Semin Immunol. Dec. 2011;23(6):418-23.
McDonald et al., Reprogrammable CRISPR/Cas9-based system for inducing site-specific DNA methylation. Biol Open. Jun. 15, 2016;5(6):866-74.
McLaughlin, Development of novel therapeutic approaches for the reduction of apolipoprotein B expression. Thesis submitted for the degree of Masters of Philosophy at the University of Leicester. 92 pages, (2014).
Morgan et al., Manipulation of nuclear architecture through CRISPR-mediated chromosomal looping. Nat Commun. Jul. 13, 2017;8:15993, 9 pages.
Narendra et al., CTCF establishes discrete functional chromatin domains at the Hox clusters during differentiation. Science. Feb. 27, 2015;347(6225):1017-21.
Okada et al., Stabilization of Foxp3 expression by CRISPR-dCas9-based epigenome editing in mouse primary T cells. Epigenetics Chromatin. May 8, 2017;10:24, 17 pages.

(56) References Cited

OTHER PUBLICATIONS

Patterson et al., DNA methylation: bisulphite modification and analysis. J Vis Exp. Oct. 21, 2011;(56):3170, 9 pages.

Rada-Iglesias et al., Whole-genome maps of USF1 and USF2 binding and histone H3 acetylation reveal new aspects of promoter structure and candidate genes for common human disorders. Genome Res. Mar. 2008;18(3):380-92.

Ran et al., Genome engineering using the CRISPR-Cas9 system. Nat Protoc. Nov. 2013;8(11):2281-2308.

Sabari et al., Coactivator condensation at super-enhancers links phase separation and gene control. Science. Jul. 27, 2018;361(6400):eaar3958, 24 pages.

Shin et al., Spatiotemporal Control of Intracellular Phase Transitions Using Light-Activated optoDroplets. Cell. Jan. 12, 2017;168(1-2):159-171.e14.

Thakore et al., Highly specific epigenome editing by CRISPR-Cas9 repressors for silencing of distal regulatory elements. Nat Methods. Dec. 2015;12(12):1143-9.

Torres et al., Potent and sustained cellular inhibition of miR-122 by lysine-derivatized peptide nucleic acids (PNA) and phosphorothioate locked nucleic acid (LNA)/2'-O-methyl (OMe) mixmer anti-miRs in the absence of transfection agents. Artif DNA PNA XNA. Jul.-Dec. 2011;2(3):71-8.

Viscidi et al., Novel chemical method for the preparation of nucleic acids for nonisotopic hybridization. J Clin Microbiol. Feb. 1986;23(2):311-7.

Vojta et al., Repurposing the CRISPR-Cas9 system for targeted DNA methylation. Nucleic Acids Res. Jul. 8, 2016;44(12):5615-28.

Woloszynska-Read et al., DNA methylation-dependent regulation of BORIS/CTCFL expression in ovarian cancer. Cancer Immun. Dec. 21, 2007;7:21, 10 pages.

Wu et al., MicroRNAs direct rapid deadenylation of mRNA. Proc Natl Acad Sci U S A. Mar. 14, 2006;103(11):4034-9.

Xu et al., A CRISPR-based approach for targeted DNA demethylation. Cell Discov. May 3, 2016;2:16009, 12 pages.

Ziebarth et al., CTCFBSDB 2.0: a database for CTCF-binding sites and genome organization. Nucleic Acids Res. Jan. 2013;41 (Database issue):D188-94.

European Office Action for Application No. 17849560.2, dated Mar. 31, 2020, 13 pages.

International Search Report and Written Opinion for Application No. PCT/US2017/050553, dated Jan. 30, 2018, 15 pages.

International Search Report and Written Opinion for Application No. PCT/US2020/052119, dated Dec. 9, 2020, 11 pages.

International Search Report and Written Opinion for Application No. PCT/US2021/021825, dated Aug. 30, 2021, 18 pages.

\* cited by examiner

COMPOSITIONS AND METHODS FOR MODULATING HEPATOCYTE NUCLEAR FACTOR 4-ALPHA (HNF4α) GENE EXPRESSION

CROSS-REFERENCE TO RELATED APPLICATIONS

The instant application claims the benefit of priority to U.S. Provisional Application No. 62/904,178, filed on Sep. 23, 2019, the entire contents of which are incorporated herein by reference.

SEQUENCE LISTING

The instant application contains a Sequence Listing which has been submitted electronically in ASCII format and is hereby incorporated by reference in its entirety. Said ASCII copy, created on Nov. 15, 2023, is named 131717-00103_SL.txt and is 4,345,503 bytes in size.

BACKGROUND OF THE INVENTION

Master regulators are proteins, such as transcription factors, with the ability to influence the expression of a network of genes related by cell type, organ system, or response to a stimulus.

One example of a master regulator is the transcription factor Hepatocyte Nuclear Factor 4-alpha (HNF4α). HNF4α is expressed for the first time in terminally differentiated liver cells, late in embryonic development. HNF4α controls the expression of proteins necessary for the normal function of hepatocytes and other cell types in the liver (Li, et al. (2000) *Genes and Devel* 14:464-474). In addition, many of these proteins are secreted by the liver cells and contribute to health systemically. For example, proteins such as albumin are required to transport nutrients, hormones, lipids, and small molecule drugs in the circulation. In fibrotic liver disease, HNF4α is dysregulated and, as a result, gene expression in its network declines significantly or stops (Guzman-Lepe, et al. (2018) *Hepatol Comm* 2(5):582). This dysregulation of the network contributes to the pathology of liver failure in the organ itself, and to co-morbidities throughout the patient.

Recently, Nishikawa et al. (2015) demonstrated that transgenic expression of HNF4α in a rat model of cirrhosis led to the restoration of gene expression throughout the HNF4α network, restored hepatocyte function, and improved health of the animal. The transgene was delivered with an adeno-associated virus (AAV). However, transgene expression from AAV delivery does not allow subtle control or temporary modification of the expression of genes already in the genome. Once modified with AAV, the affected cells lose the ability to respond to changing conditions in the organ and body in a nimble physiologically meaningful way.

Accordingly there is a need in the art for temporary and labile effectors that offer greater control and the ability to restore cells and tissues to a nascent "normal" state and, thus, treat HNF4α-associated disease, such as fibrotic liver disease, e.g., cirrhosis.

SUMMARY OF THE INVENTION

The present invention provides agents and compositions for modulating the expression (e.g., enhancing or reducing expression) of a hepatocyte nuclear factor 4 alpha (HNF4α) gene by targeting an HNF4α expression control region. The HNF4α gene may be in a cell, e.g., a mammalian cell, such as a mammalian somatic cell, e.g., a human somatic cell. The present invention also provides methods of using the agents and compositions of the invention for modulating the expression of an HNF4α gene or for treating a subject who would benefit from modulating the expression of an HNF4α gene, e.g., a subject suffering or prone to suffering from an HNF4α-associated disease.

Accordingly, in one aspect, the present invention provides a site-specific disrupting agent, comprising a site-specific HNF4α targeting moiety which targets an HNF4α expression control region.

In some embodiments, the site-specific HNF4α targeting moiety comprises a polymeric molecule.

The polymeric molecule may comprise a polyamide, a polynucleotide, a polynucleotide encoding a DNA-binding domain, or fragment thereof, that specifically binds to the HNF4α expression control region, or a peptide nucleic acid (PNA).

In some embodiments, the expression control region comprises an HNF4α-specific transcriptional control element.

In some embodiments, the transcriptional control element comprises an HNF4α promoter, such as the nucleotide sequence of HNF4α promoter 1, or a fragment thereof, or the nucleotide sequence of HNF4α promoter 2, or a fragment thereof.

In some embodiments, the transcriptional control element comprises a transcriptional enhancer.

In some embodiments, the transcriptional control element comprises a transcriptional repressor.

In some embodiments, the site-specific HNF4α disrupting agent comprises a nucleotide sequence having at least 85%, 86%, 87%, 88%, 89%, 90%, 91%, 92%, 93%, 94%, 95%, 96%, 97%, 98%, 99%, or 100% nucleotide identity to the entire nucleotide sequence of any of the nucleotide sequences in any one of Tables 2, 3, 4, and 9.

In some embodiments, the site-specific HNF4α disrupting agent comprises a polynucleotide encoding a DNA-binding domain of a Transcription activator-like effector (TALE) polypeptide or a zinc finger (ZNF) polypeptide, or fragment thereof, that specifically binds to the HNF4α expression control region.

In one embodiment, the DNA-binding domain of the TALE or ZNF polypeptide comprises an amino acid sequence having at least about 85%, 86%, 87%, 88%, 89%, 90%, 91%, 92%, 93%, 94%, 95%, 96%, 97%, 98%, 99%, or 100% amino acid identity to the entire amino acid sequence of any one of the amino acid sequences listed in column 5 of Table 6A or column 4 of Table 10. In one embodiment, DNA-binding domain of the TALE or ZNF polypeptide comprises an amino acid sequence having at least about 85%, 86%, 87%, 88%, 89%, 90%, 91%, 92%, 93%, 94%, 95%, 96%, 97%, 98%, 99%, or 100% amino acid identity to the entire amino acid sequence of ZF5.3. In one embodiment, DNA-binding domain of the TALE or ZNF polypeptide comprises an amino acid sequence having at least about 85%, 86%, 87%, 88%, 89%, 90%, 91%, 92%, 93%, 94%, 95%, 96%, 97%, 98%, 99%, or 100% amino acid identity to the entire amino acid sequence of ZF7. In one embodiment, DNA-binding domain of the TALE or ZNF polypeptide comprises an amino acid sequence having at least about 85%, 86%, 87%, 88%, 89%, 90%, 91%, 92%, 93%, 94%, 95%, 96%, 97%, 98%, 99%, or 100% amino acid identity to the entire amino acid sequence of ZF14. In one embodiment, DNA-binding domain of the TALE or ZNF polypeptide comprises an amino acid sequence having at least about 85%, 86%, 87%, 88%, 89%, 90%, 91%, 92%, 93%, 94%, 95%, 96%, 97%, 98%, 99%, or 100% amino acid identity to the entire amino acid sequence of ZF15.

In some embodiments, the expression control region comprises one or more HNF4α-associated anchor sequences within an anchor sequence-mediated conjunction comprising a first and a second HNF4α-associated anchor sequence.

In some embodiments, the anchor sequence comprises a CCCTC-binding factor (CTCF) binding motif.

In some embodiments, the anchor sequence-mediated conjunction comprises one or more transcriptional control elements internal to the conjunction.

In some embodiments, the anchor sequence-mediated conjunction comprises one or more transcriptional control elements external to the conjunction.

In some embodiments, the first and/or the second anchor sequence is located within about 500 kb of the transcriptional control element.

In some embodiments, the first and/or the second anchor sequence is located within 300 kb of the transcriptional control element.

In some embodiments, the site-specific HNF4α disrupting agent comprises a nucleotide modification.

The present invention also provides vectors, such as viral expression vectors and cells comprising the site-specific HNF4α disrupting agents of the invention as well as the vectors of the invention.

In some embodiments, the site-specific HNF4α disrupting agents of the invention are present in a composition, such as a pharmaceutical composition.

In some embodiments, the pharmaceutical composition comprises a lipid formulation.

In some embodiments, the lipid formulation comprises one or more cationic lipids, one or more non-cationic lipids, one or more cholesterol-based lipids, or one or more PEG-modified lipids, or combinations of any of the foregoing.

In some embodiments, the pharmaceutical composition comprises a lipid nanoparticle.

In another aspect, the present invention provides a site-specific HNF4α disrupting agent, comprising a nucleic acid molecule encoding a fusion protein, the fusion protein comprising a site-specific HNF4α targeting moiety which targets an HNF4α expression control region and an effector molecule.

In some embodiments, the site-specific HNF4α targeting moiety comprises a polynucleotide encoding a DNA-binding domain of a Transcription activator-like effector (TALE) polypeptide or a zinc finger (ZNF) polypeptide, or fragment thereof, that specifically binds to the HNF4α expression control region.

In one embodiment, the the DNA-binding domain of the TALE comprises an amino acid sequence having at least 85%, 86%, 87%, 88%, 89%, 90%, 91%, 92%, 93%, 94%, 95%, 96%, 97%, 98%, 99%, or 100% amino acid identity to the entire amino acid sequence of an amino acid sequence selected from the amino acid sequences listed in column 5 of Table 6A or column 4 of Table 10.

In some embodiments, the effector molecule comprises a polypeptide or a nucleic acid molecule encoding a polypeptide.

In some embodiments, the fusion protein comprises a peptide-nucleic acid fusion.

In some embodiments, the effector is selected from the group consisting of a nuclease, a physical blocker, an epigenetic recruiter, and an epigenetic CpG modifier, and combinations of any of the foregoing.

In some embodiments, the effector comprises a CRISPR associated protein (Cas) polypeptide or nucleic acid molecule encoding the Cas polypeptide.

In some embodiments, the Cas polypeptide is an enzymatically inactive Cas polypeptide.

In some embodiments, the Cas polypeptide comprises a catalytically active domain of human exonuclease 1 (hEXO1).

In some embodiments, the epigenetic recruiter comprises a transcriptional enhancer or a transcriptional repressor.

In one embodiment, the transcriptional enhancer is a VPR (VP64-p65-Rta).

In one embodiment, the VPR comprises an amino acid sequence having at least about 85%, 86%, 87%, 88%, 89%, 90%, 91%, 92%, 93%, 94%, 95%, 96%, 97%, 98%, 99%, or 100% amino acid identity to the entire amino acid sequence of (SEQ ID NO: 66)
DALDDFDLDMLGSDALDDFDLDMLGSDALDDFDLDMLGSDALDD

FDLDMLSGGPKKKRKVGSQYLPDTDDRHRIEEKRKRTYETFKSI

MKKSPFSGPTDPRPPPRRIAVPSRSSASVPKPAPQPYPFTSSLS

TINYDEFPTMVFPSGQISQASALAPAPPQVLPQAPAPAPAPAMV

SALAQAPAPVPVLAPGPPQAVAPPAPKPTQAGEGTLSEALLQLQ

FDDEDLGALLGNSTDPAVFTDLASVDNSEFQQLLNQGIPVAPHT

TEPMLMEYPEAITRLVTGAQRPPDPAPAPLGAPGLPNGLLSGDE

DFSSIADMDFSALLGSGSGSRDSREGMFLPKPEAGSAISDVFEG

REVCQPKRLRPFHPPGSPWANRPLPASLAPTPTGPVHEPVGSLT

PAPVPQPLDPAPAVTPEASHLLEDPDEETSQAVKALREMADTVI

PQKEEAAICGQMDLSHPPPRGHLDELTTTLESMTEDLNLDSPLT

PELNEILDTFLNDECLLHAMHISTGLSIFDTSLF.

In one embodiment, the transcriptional enhancer comprises two, three, four, or five VPRs.

In one embodiment, the transcriptional enhancer is a p300.

In one embodiment, the p300 comprises an amino acid sequence having at least about 85% 85%, 86%, 87%, 88%, 89%, 90%, 91%, 92%, 93%, 94%, 95%, 96%, 97%, 98%, 99%, or 100% identity to the entire amino acid sequence of (SEQ ID NO: 67)
IFKPEELRQALMPTLEALYRQDPESLPFRQPVDPQLLGIPDYF

DIVKSPMDLSTIKRKLDTGQYQEPWQYVDDIWLMFNNAWLYNR

KTSRVYKYCSKLSEVFEQEIDPVMQSLGYCCGRKLEFSPQTLC

CYGKQLCTIPRDATYYSYQNRYHFCEKCFNEIQGESVSLGDDP

SQPQTTINKEQFSKRKNDTLDPELFVECTECGRKMHQICVLHH

EIIVVPAGFVCDGCLKKSARTRKENKFSAKRLPSTRLGTFLEN

RVNDFLRRQNHPESGEVTVRVVHASDKTVEVKPGMKARFVDSG

EMAESFPYRTKALFAFEEIDGVDLCFFGMHVQEYGSDCPPPNQ

RRVYISYLDSVHFFRPKCLRTAVYHEILIGYLEYVKKLGYTTG

HIVVACPPSEGDDYIFHCHPPDQKIPKPKRLQEWYKKMLDKAV

-continued

SERIVHDYKDIFKQATEDRLTSAKELPYFEGDFWPNVLEESIK

ELEQEEEERKREENTSNESTDVTKGDSKNAKKKNNKKTSKNKS

SLSRGNKKKPGMPNVSNDLSQKLYATMEKHKEVFFVIRLIAGP

PAANSLPPIVDPDPLIPCDLMDGRDAFLTLARDKHLEFSSLRR

AQWSTMCMLVELHTQSQD.

In some embodiments, the epigenetic CpG modifier comprises a DNA methylase, a DNA demethylase, a histone modifying agent, or a histone deacetylase.

In some embodiments, the effector molecule comprises a zinc finger polypeptide.

In some embodiments, the effector molecule comprises a Transcription activator-like effector nuclease (TALEN) polypeptide.

In some embodiments, the site-specific HNF4α disrupting agent further comprises a second nucleic acid molecule encoding a second fusion protein, wherein the second fusion comprises a second site-specific HNF4α targeting moiety which targets a second HNF4α expression control region and a second effector molecule, wherein the second HNF4α expression control region is different than the HNF4α expression control region.

In one embodiment, the HNF4α expression control region comprises a ZF5 target sequence GGCGGGGGACCGATTAACCAT (SEQ ID NO: 118) and the second HNF4α expression control region comprises a ZF7 target sequence ACTGAACATCGGTGAGTTAGG (SEQ ID NO: 126).

In one embodiment, the second effector is different than the first effector.

In one embodiment, the second effector is the same as the first effector.

In one embodiment, the fusion protein and the second fusion protein are operably linked.

In one embodiment, the fusion protein and the second fusion protein comprise an amino acid sequence that has at least about 85%, 86%, 87%, 88%, 89%, 90%, 91%, 92%, 93%, 94%, 95%, 96%, 97%, 98%, 99%, or 100% amino acid sequence identity to the entire amino acid sequence of a polypeptide selected from the group consisting of ZF5.3-VPR-tPT2a-ZF7-VPR; ZF7-VPR-tPT2a-ZF5.3-VPR; ZF5.3-VPR-tPT2a-ZF7-p300; and ZF7-p300-tPT2a-ZF5.3-VPR.

In one embodiment, the fusion protein comprises an amino acid sequence having at least about 85%, 86%, 87%, 88%, 89%, 90%, 91%, 92%, 93%, 94%, 95%, 96%, 97%, 98%, 99%, or 100% amino acid sequence identity to the entire amino acid sequence of ZF5.3-VPR.

In one embodiment, the fusion protein is encoded by a polynucleotide comprising a nucleotide sequence having at least about 85%, 86%, 87%, 88%, 89%, 90%, 91%, 92%, 93%, 94%, 95%, 96%, 97%, 98%, 99%, or 100% nucleotide sequence identity to the entire nucleotide sequence of a polynucleotide selected from the group consisting of ZF5-VPR mRNA, ZF5.1-VPR mRNA, ZF5.2-VPR mRNA, ZF5.3-VPR mRNA, ZF5.4-VPR mRNA, ZF5.5-VPR mRNA, and ZF5.6-VPR mRNA.

In one aspect, the present invention provides a site-specific HNF4α disrupting agent. The disrupting agent includes a nucleic acid molecule encoding a fusion protein, wherein the fusion protein comprises an amino acid sequence having at least about 85%, 86%, 87%, 88%, 89%, 90%, 91%, 92%, 93%, 94%, 95%, 96%, 97%, 98%, 99%, or 100% amino acid identity to the entire amino acid sequence of a polypeptide selected from the group consisting of ZF1-VPR, ZF2-VPR, ZF3-VPR, ZF4-VPR, ZF5-VPR, ZF5.3-VPR, ZF6-VPR, ZF7-VPR, ZF8-VPR, ZF9-VPR, ZF10-VPR, ZF11-VPR, ZF12-VPR, ZF13-VPR, ZF14-VPR, and ZF15-VPR.

In one embodiment, the polypeptide is selected from the group consisting of ZF5-VPR, ZF5.3-VPR, ZF7-VPR, ZF10-VPR, ZF14-VPR, and ZF15-VPR.

In one embodiment, the polypeptide is ZF5.3-VPR.

The present invention also provides vectors, such as viral expression vectors and cells comprising the site-specific HNF4α disrupting agents of the invention as well as the vectors of the invention.

In some embodiments, the site-specific HNF4α disrupting agents of the invention are present in a composition, such as a pharmaceutical composition.

In some embodiments, the pharmaceutical composition comprises a lipid formulation.

In some embodiments, the lipid formulation comprises one or more cationic lipids, one or more non-cationic lipids, one or more cholesterol-based lipids, or one or more PEG-modified lipids, or combinations of any of the foregoing.

In some embodiments, the pharmaceutical composition comprises a lipid nanoparticle.

In one aspect, the present invention provides a method of modulating expression of hepatocyte nuclear factor 4 alpha-(HNF4α) in a cell. The method includes contacting the cell with a site-specific HNF4α disrupting agent, the disrupting agent comprising a site-specific HNF4α targeting moiety which targets an HNF4α expression control region, and an effector molecule, thereby modulating expression of HNF4α in the cell.

The modulation of expression may be enhanced expression of HNF4α in the cell or reduced expression of HNF4α in the cell.

In some embodiments, the site-specific HNF4α targeting moiety comprises a polymeric molecule.

The polymeric molecule may comprise a polyamide, a polynucleotide, a peptide nucleic acid (PNA).

In some embodiments, the expression control region comprises an HNF4α-specific transcriptional control element.

In some embodiments, the transcriptional control element comprises an HNF4α promoter, such as the nucleotide sequence of HNF4α promoter 1, or a fragment thereof, or the nucleotide sequence of HNF4α promoter 2, or a fragment thereof.

In some embodiments, the transcriptional control element comprises a transcriptional enhancer.

In some embodiments, the transcriptional control element comprises a transcriptional repressor.

In some embodiments, the site-specific HNF4α disrupting agent comprises a nucleotide sequence having at least 85%, 86%, 87%, 88%, 89%, 90%, 91%, 92%, 93%, 94%, 95%, 96%, 97%, 98%, 99%, or 100% nucleotide identity to the entire nucleotide sequence of any of the nucleotide sequences in any one of Tables 2, 3, 4, and 9.

In some embodiments, the site-specific HNF4α disrupting agent comprises a polynucleotide encoding a DNA-binding domain of a Transcription activator-like effector (TALE) polypeptide or a zinc finger (ZNF) polypeptide, or fragment thereof, that specifically binds to the HNF4α expression control region.

In some embodiments, the DNA-binding domain of the TALE or ZNF comprises an amino acid sequence having at least 85%, 86%, 87%, 88%, 89%, 90%, 91%, 92%, 93%, 94%, 95%, 96%, 97%, 98%, 99%, or 100% amino acid identity to the entire amino acid sequence of an amino acid sequence selected from the amino acid sequences listed in column 5 of Table 6A or column 4 of Table 10.

In some embodiments, the expression control region comprises one or more HNF4α-associated anchor sequences within an anchor sequence-mediated conjunction comprising a first and a second HNF4α-associated anchor sequence.

In some embodiments, the anchor sequence comprises a CCCTC-binding factor (CTCF) binding motif.

In some embodiments, the anchor sequence-mediated conjunction comprises one or more transcriptional control elements internal to the conjunction.

In some embodiments, the anchor sequence-mediated conjunction comprises one or more transcriptional control elements external to the conjunction.

In some embodiments, the first and/or the second anchor sequence is located within about 500 kb of the transcriptional control element.

In some embodiments, the first and/or the second anchor sequence is located within 300 kb of the transcriptional control element.

In some embodiments, the site-specific HNF4α disrupting agent comprises a nucleotide modification.

In some embodiments, the effector molecule comprises a polypeptide.

In some embodiments, the polypeptide comprises a nucleic acid molecule encoding a fusion protein comprising the site-specific HNF4α targeting moiety which targets an HNF4α expression regulatory region, and the effector molecule.

In some embodiments, the fusion protein comprises a peptide-nucleic acid fusion molecule.

In some embodiments, the effector is selected from the group consisting of a nuclease, a physical blocker, an epigenetic recruiter, and an epigenetic CpG modifier, and combinations of any of the foregoing.

In some embodiments, the effector comprises a CRISPR associated protein (Cas) polypeptide or nucleic acid molecule encoding the Cas polypeptide.

In some embodiments, the Cas polypeptide is an enzymatically inactive Cas polypeptide.

In some embodiments, the Cas polypeptide further comprises a catalytically active domain of human exonuclease 1 (hEXO1).

In some embodiments, the epigenetic recruiter comprises a transcriptional enhancer or a transcriptional repressor.

In some embodiments, the transcriptional enhancer is a VPR.

In some embodiments, the VPR comprises an amino acid sequence having at least about 85%, 86%, 87%, 88%, 89%, 90%, 91%, 92%, 93%, 94%, 95%, 96%, 97%, 98%, 99%, or 100% amino acid identity to the entire amino acid sequence of (SEQ ID NO: 66)
DALDDFDLDMLGSDALDDFDLDMLGSDALDDFDLDMLGSDALD

DFDLDMLSGGPKKKRKVGSQYLPDTDDRHRIEEKRKRTYETFK

SIMKKSPFSGPTDPRPPPRRIAVPSRSSASVPKPAPQPYPFTS

SLSTINYDEFPTMVFPSGQISQASALAPAPPQVLPQAPAPAPA

PAMVSALAQAPAPVPVLAPGPPQAVAPPAPKPTQAGEGTLSEA

LLQLQFDDEDLGALLGNSTDPAVFTDLASVDNSEFQQLLNQGI

PVAPHTTEPMLMEYPEAITRLVTGAQRPPDPAPAPLGAPGLPN

GLLSGDEDFSSIADMDFSALLGSGSGSRDSREGMFLPKPEAGS

AISDVFEGREVCQPKRLRPFHPPGSPWANRPLPASLAPTPTGP

VHEPVGSLTPAPVPQPLDPAPAVTPEASHLLEDPDEETSQAVK

ALREMADTVIPQKEEAAICGQMDLSHPPPRGHLDELTTTLESM

TEDLNLDSPLTPELNEILDTFLNDECLLHAMHISTGLSIFDTSLF.

In some embodiments, the transcriptional enhancer comprises two, three, four, or five VPRs.

In some embodiments, the transcriptional enhancer is a p300.

In some embodiments, the p300 has an amino acid sequence having at least about 85%, 86%, 87%, 88%, 89%, 90%, 91%, 92%, 93%, 94%, 95%, 96%, 97%, 98%, 99%, or 100% amino acid identity to the entire amino acid sequence of (SEQ ID NO: 67)
IFKPEELRQALMPTLEALYRQDPESLPFRQPVDPQLLGIPDYFDIVKSPM

DLSTIKRKLDTGQYQEPWQYVDDIWLMFNNAWLYNRKTSRVYKYCSKLSE

VFEQEIDPVMQSLGYCCGRKLEFSPQTLCCYGKQLCTIPRDATYYSYQNR

YHFCEKCFNEIQGESVSLGDDPSQPQTTINKEQFSKRKNDTLDPELFVEC

TECGRKMHQICVLHHEIIWPAGFVCDGCLKKSARTRKENKFSAKRLPSTR

LGTFLENRVNDFLRRQNHPESGEVTVRVVHASDKTVEVKPGMKARFVDSG

EMAESFPYRTKALFAFEEIDGVDLCFFGMHVQEYGSDCPPPNQRRVYISY

LDSVHFFRPKCLRTAVYHEILIGYLEYVKKLGYTTGHIWACPPSEGDDYI

FHCHPPDQKIPKPKRLQEWYKKMLDKAVSERIVHDYKDIFKQATEDRLTS

AKELPYFEGDFWPNVLEESIKELEQEEEERKREENTSNESTDVTKGDSKN

AKKKNNKKTSKNKSSLSRGNKKKPGMPNVSNDLSQKLYATMEKHKEVFFV

IRLIAGPAANSLPPIVDPDPLIPCDLMDGRDAFLTLARDKHLEFSSLRRA

QWSTMCMLVELHTQSQD.

In some embodiments, the epigenetic CpG modifier comprises a DNA methylase, a DNA demethylase, a histone modifying agent, or a histone deacetylase.

In some embodiments, the effector molecule comprises a zinc finger polypeptide.

In some embodiments, the effector molecule comprises a Transcription activator-like effector nuclease (TALEN) polypeptide.

In some embodiments, the fusion protein comprises an enzymatically inactive Cas polypeptide and an epigenetic recruiter polypeptide.

In some embodiments, the fusion protein comprises an enzymatically Cas polypeptide and an epigenetic CpG modifier polypeptide.

In some embodiments, the site-specific HNF4α disrupting agent comprises a second nucleic acid molecule encoding a second fusion protein, wherein the second fusion protein comprises a second site-specific HNF4α targeting moiety which targets a second HNF4α expression control region and a second effector molecule, wherein the second HNF4α expression control region is different than the HNF4α expression control region.

In some embodiments, the HNF4α expression control region comprises a ZF5 target sequence GGCGGGGGACC-GATTAACCAT (SEQ ID NO: 118) and the second HNF4α expression control region comprises a ZF7 target sequence ACTGAACATCGGTGAGTTAGG (SEQ ID NO: 126).

In some embodiments, the second effector is different than the effector.

In some embodiments, the second effector is the same as the effector.

In some embodiments, the fusion protein and the second fusion protein are operably linked.

In some embodiments, the fusion protein and the second fusion protein comprise an amino acid sequence that has at least about 85%, 86%, 87%, 88%, 89%, 90%, 91%, 92%, 93%, 94%, 95%, 96%, 97%, 98%, 99%, or 100% sequence identity to the entire amino acid sequence of a polypeptide selected from ZF5.3-VPR-tPT2a-ZF7-VPR protein, ZF7-VPR-tPT2a-ZF5.3-VPR protein, ZF5.3-VPR-tPT2a-ZF7-p300 protein, and ZF7-p300-tPT2a-ZF5.3-VPR protein.

In some embodiments, the fusion protein comprises an amino acid sequence having at least 85%, 86%, 87%, 88%, 89%, 90%, 91%, 92%, 93%, 94%, 95%, 96%, 97%, 98%, 99%, or 100% sequence identity to the entire amino acid sequence of ZF5.3-VPR protein.

In some embodiments, the fusion protein is encoded by a polynucleotide having a sequence that has at least about 85%, 86%, 87%, 88%, 89%, 90%, 91%, 92%, 93%, 94%, 95%, 96%, 97%, 98%, 99%, or 100% sequence identity to the entire nucleotide sequence of a polynucleotide selected from the group consisting of ZF5-VPR mRNA, ZF5.1-VPR mRNA, ZF5.2-VPR mRNA, ZF5.3-VPR mRNA, ZF5.4-VPR mRNA, ZF5.5-VPR mRNA, and ZF5.6-VPR mRNA.

In some embodiments, the administration of the site-specific HNF4α disrupting agent and the second site-specific HNF4α disrupting agent has a synergistic effect in modulating the expression of HNF4α.

In some embodiments, the HNF4α expression control region comprises a ZF5 target sequence GGCGGGGGACCGATTAACCAT (SEQ ID NO: 118) and the second HNF4α expression control region comprises a sequence selected from ZF7 target sequence ACTGAACATCGGTGAGTTAGG (SEQ ID NO: 126), ZF10 target sequence CCTGCAGCCCCGCCCAGCCTA (SEQ ID NO: 138), ZF14 target sequence GGAGGGGTGGGGGTTAATGGT (SEQ ID NO: 154), and ZF15 target sequence GAAGGGGTGGAGGCTCTGCCG (SEQ ID NO: 158).

In some embodiments, the HNF4α expression control region comprises a ZF5 target sequence GGCGGGGGACCGATTAACCAT (SEQ ID NO: 118) and the second HNF4α expression control region comprises a ZF7 target sequence ACTGAACATCGGTGAGTTAGG (SEQ ID NO: 126).

In some embodiments, the fusion protein comprises a sequence having at least 85%, 86%, 87%, 88%, 89%, 90%, 91%, 92%, 93%, 94%, 95%, 96%, 97%, 98%, 99%, or 100% sequence identity to the entire amino acid sequence of ZF5-VPR, and the second fusion protein comprises a sequence having at least 85%, 86%, 87%, 88%, 89%, 90%, 91%, 92%, 93%, 94%, 95%, 96%, 97%, 98%, 99%, or 100% sequence identity to the entire amino acid sequence of a polypeptide selected from ZF7-VPR, ZF10-VPR, ZF14-VPR, and ZF15-VPR.

In some embodiments, the fusion protein comprises an amino acid sequence having at least about 85%, 86%, 87%, 88%, 89%, 90%, 91%, 92%, 93%, 94%, 95%, 96%, 97%, 98%, 99%, or 100% identity to the entire amino acid sequence of a polypeptide selected from the group consisting of ZF1-VPR, ZF2-VPR, ZF3-VPR, ZF4-VPR, ZF5-VPR, ZF5.3-VPR, ZF6-VPR, ZF7-VPR, ZF8-VPR, ZF9-VPR, ZF10-VPR, ZF11-VPR, ZF12-VPR, ZF13-VPR, ZF14-VPR, and ZF15-VPR.

In some embodiments, the polypeptide is selected from the group consisting of ZF5-VPR, ZF5.3-VPR, ZF7-VPR, ZF10-VPR, ZF14-VPR, and ZF15-VPR.

In some embodiments, the polypeptide is ZF5.3-VPR.

In some embodiments, the site-specific disrupting agent, the effector, or both the site-specific disrupting agent and the effector are present in a vector, such as a viral expression vector.

In some embodiments, the site-specific disrupting agent and the effector are present in the same vector.

In some embodiments, the site-specific disrupting agent and the effector are present in different vectors.

In some embodiments, the site-specific disrupting agent, the effector, or both the site-specific disrupting agent and the effector are present in a composition.

In some embodiments, the site-specific disrupting agent and the effector are present in the same composition.

In some embodiments, the site-specific disrupting agent and the effector are present in different compositions.

In some embodiments, the composition comprises a pharmaceutical composition.

In some embodiments, the pharmaceutical composition comprises a lipid formulation.

In some embodiments, the lipid formulation comprises one or more cationic lipids, one or more non-cationic lipids, one or more cholesterol-based lipids, or one or more PEG-modified lipids, or combinations of any of the foregoing.

In some embodiments, the pharmaceutical composition comprises a lipid nanoparticle.

In some embodiments, the cell is a mammalian cell, such as a somatic cell or a primary cell.

In some embodiments, the contacting is performed in vitro.

In some embodiments, the contacting is performed in vivo.

In some embodiments, the contacting is performed ex vivo.

In some embodiments, the methods of the invention further comprise administering the cell to a subject.

In some embodiments, the cell is within a subject.

In some embodiments, the subject has an HNF4α-associated disease.

In some embodiments, the HNF4α-associated disease is selected from the group consisting of fatty liver (steatosis), nonalcoholic steatohepatitis (NASH), cirrhosis of the liver, accumulation of fat in the liver, inflammation of the liver, hepatocellular necrosis, liver fibrosis, and nonalcoholic fatty liver disease (NAFLD), polycystic kidney disease, inflammatory bowel disease (IBD), and MODY I.

In another aspect, the present invention provides a method for treating a subject having an HNF4α-associated disease. The method includes administering to the subject a therapeutically effective amount of the site-specific HNF4α disrupting agent, the disrupting agent comprising a site-specific HNF4α targeting moiety which targets an HNF4α expression control region, and an effector molecule, thereby treating the subject.

In some embodiments, the HNF4α-associated disease is hepatocellular cancer and the site-specific HNF4α disrupting agent reduces expression of HNF4α in the subject.

In some embodiments, the HNF4α-associated disease is selected from the group consisting of fatty liver (steatosis), nonalcoholic steatohepatitis (NASH), cirrhosis of the liver, accumulation of fat in the liver, inflammation of the liver, hepatocellular necrosis, liver fibrosis, and nonalcoholic fatty liver disease (NAFLD) and the site-specific HNF4α disrupting agent enhances expression of HNF4α in the subject.

In some embodiments, the site-specific HNF4α disrupting agent and the effector molecule are administered to the subject concurrently.

In some embodiments, the site-specific HNF4α disrupting agent and the effector molecule are administered to the subject sequentially.

In some embodiments, the effector molecule is administered to the subject prior to administration of the site-specific HNF4α disrupting agent.

In some embodiments, the site-specific HNF4α disrupting agent is administered to the subject prior to administration of the effector molecule.

In one aspect, the present invention provides a site-specific HNF4α disrupting agent, comprising a site-specific HNF4α targeting moiety which targets an HNF4α expression control region, wherein the HNFα expression control region comprises the nucleotide sequence of any one of the nucleotide sequences listed in column 3 of Table 1 or column 4 of Table 10.

In one embodiment, the site-specific HNF4α targeting moiety comprises a nucleotide sequence having at least 85%, 86%, 87%, 88%, 89%, 90%, 91%, 92%, 93%, 94%, 95%, 96%, 97%, 98%, 99%, or 100% nucleotide identity to the entire nucleotide sequence of any of the nucleotide sequences in any one of Table 2, 3, 4, and 9.

In one embodiment, the site-specific HNF4α targeting moiety comprises a polymeric molecule comprising a polynucleotide encoding a DNA-binding domain of a Transcription activator-like effector (TALE) polypeptide or a zinc finger (ZNF) polypeptide, or fragment thereof, that specifically binds to the HNF4α expression control region.

In one embodiment, the DNA-binding domain of the TALE or ZNF polypeptide comprises an amino acid sequence having at least about 85%, 86%, 87%, 88%, 89%, 90%, 91%, 92%, 93%, 94%, 95%, 96%, 97%, 98%, 99%, or 100% amino acid identity to the entire amino acid sequence of any one of the amino acid sequences listed in column 5 of Table 6A or column 4 of Table 10.

In one embodiment, the HNFα expression control region comprises a nucleotide sequence of a ZF5 target sequence GGCGGGGGACCGATTAACCAT (SEQ ID NO: 118).

In one embodiment, the HNFα expression control region comprises a nucleotide sequence of a ZF7 target sequence ACTGAACATCGGTGAGTTAGG (SEQ ID NO: 126).

In one aspect, the present invention provides a site-specific HNF4α disrupting agent, comprising a polynucleotide encoding the amino acid sequence of ZF5-VPR comprising the amino acid sequence of (SEQ ID NO: 301)
MAPKKKRKVGIHGVPAAGSSGSLEPGEKPYKCPECGKSFSTSGNLTEHQR

THTGEKPYKCPECGKSFSDSGNLRVHQRTHTGEKPYKCPECGKSFSHKNA

LQNHQRTHTGEKPYKCPECGKSFSRNDTLTEHQRTHTGEKPYKCPECGKS

FSQRAHLERHQRTHTGEKPYKCPECGKSFSRSDKLVRHQRTHTGEKPYKC

PECGKSFSDPGHLVRHQRTHTGEKPTGKKTSASGSGGGSGGDALDDFDLD

MLGSDALDDFDLDMLGSDALDDFDLDMLGSDALDDFDLDMLSGGPKKKRK

VGSQYLPDTDDRHRIEEKRKRTYETFKSIMKKSPFSGPTDPRPPPRRIAV

PSRSSASVPKPAPQPYPFTSSLSTINYDEFPTMVFPSGQISQASALAPAP

PQVLPQAPAPAPAPAMVSALAQAPAPVPVLAPGPPQAVAPPAPKPTQAGE

GTLSEALLQLQFDDEDLGALLGNSTDPAVFTDLASVDNSEFQQLLNQGIP

VAPHTTEPMLMEYPEAITRLVTGAQRPPDPAPAPLGAPGLPNGLLSGDED

FSSIADMDFSALLGSGSGSRDSREGMFLPKPEAGSAISDVFEGREVCQPK

RLRPFHPPGSPWANRPLPASLAPTPTGPVHEPVGSLTPAPVPQPLDPAPA

VTPEASHLLEDPDEETSQAVKALREMADTVIPQKEEAAICGQMDLSHPPP

RGHLDELTTTLESMTEDLNLDSPLTPELNEILDTFLNDECLLHAMHISTG

LSIFDTSLFSGGKRPAATKKAGQAKKKKGSYPYDVPDYA.

In another aspect, the present invention provides a site-specific HNF4α disrupting agent, comprising a polynucleotide encoding the amino acid sequence of ZF5.3-VPR comprising the amino acid sequence of (SEQ ID NO: 301)
MAPKKKRKVGIHGVPAAGSSGSLEPGEKPYKCPECGKSFSTSGNLTEHQR

THTGEKPYKCPECGKSFSDSGNLRVHQRTHTGEKPYKCPECGKSFSHKNA

LQNHQRTHTGEKPYKCPECGKSFSRNDTLTEHQRTHTGEKPYKCPECGKS

FSQRAHLERHQRTHTGEKPYKCPECGKSFSRSDKLVRHQRTHTGEKPYKC

PECGKSFSDPGHLVRHQRTHTGEKPTGKKTSASGSGGGSGGDALDDFDLD

MLGSDALDDFDLDMLGSDALDDFDLDMLGSDALDDFDLDMLSGGPKKKRK

VGSQYLPDTDDRHRIEEKRKRTYETFKSIMKKSPFSGPTDPRPPPRRIAV

PSRSSASVPKPAPQPYPFTSSLSTINYDEFPTMVFPSGQISQASALAPAP

PQVLPQAPAPAPAPAMVSALAQAPAPVPVLAPGPPQAVAPPAPKPTQAGE

GTLSEALLQLQFDDEDLGALLGNSTDPAVFTDLASVDNSEFQQLLNQGIP

VAPHTTEPMLMEYPEAITRLVTGAQRPPDPAPAPLGAPGLPNGLLSGDED

FSSIADMDFSALLGSGSGSRDSREGMFLPKPEAGSAISDVFEGREVCQPK

RLRPFHPPGSPWANRPLPASLAPTPTGPVHEPVGSLTPAPVPQPLDPAPA

VTPEASHLLEDPDEETSQAVKALREMADTVIPQKEEAAICGQMDLSHPPP

RGHLDELTTTLESMTEDLNLDSPLTPELNEILDTFLNDECLLHAMHISTG

LSIFDTSLFSGGKRPAATKKAGQAKKKKGSYPYDVPDYA.

In yet another aspect, the present invention provides a site-specific HNF4α disrupting agent, comprising a polynucleotide encoding the amino acid sequence of ZF7-VPR comprising the amino acid sequence of (SEQ ID NO: 302)
MAPKKKRKVGIHGVPAAGSSGSLEPGEKPYKCPECGKSFSRSDHLTNHQR

THTGEKPYKCPECGKSFSTSGSLVRHQRTHTGEKPYKCPECGKSFSQAGH

LASHQRTHTGEKPYKCPECGKSFSRSDKLTEHQRTHTGEKPYKCPECGKS

FSTSGNLTEHQRTHTGEKPYKCPECGKSFSQSSNLVRHQRTHTGEKPYKC

PECGKSFSTHLDLIRHQRTHTGEKPTGKKTSASGSGGGSGGDALDDFDLD

MLGSDALDDFDLDMLGSDALDDFDLDMLGSDALDDFDLDMLSGGPKKKRK

VGSQYLPDTDDRHRIEEKRKRTYETFKSIMKKSPFSGPTDPRPPPRRIAV

PSRSSASVPKPAPQPYPFTSSLSTINYDEFPTMVFPSGQISQASALAPAP

PQVLPQAPAPAPAPAMVSALAQAPAPVPVLAPGPPQAVAPPAPKPTQAGE

GTLSEALLQLQFDDEDLGALLGNSTDPAVFTDLASVDNSEFQQLLNQGIP

-continued

VAPHTTEPMLMEYPEAITRLVTGAQRPPDPAPAPLGAPGLPNGLLSGDED

FSSIADMDFSALLGSGSGSRDSREGMFLPKPEAGSAISDVFEGREVCQPK

RLRPFHPPGSPWANRPLPASLAPTPTGPVHEPVGSLTPAPVPQPLDPAPA

VTPEASHLLEDPDEETSQAVKALREMADTVIPQKEEAAICGQMDLSHPPP

RGHLDELTTTLESMTEDLNLDSPLTPELNEILDTFLNDECLLHAMHISTG

LSIFDTSLFSGGKRPAATKKAGQAKKKKGSYPYDVPDYA.

In one aspect, the present invention provides a site-specific HNF4α disrupting agent, comprising a polynucleotide encoding the amino acid sequence of ZF10-VPR comprising the amino acid sequence of (SEQ ID NO: 303)
MAPKKKRKVGIHGVPAAGSSGSLEPGEKPYKCPECGKSFSQNSTLTEHQR

THTGEKPYKCPECGKSFSERSHLREHQRTHTGEKPYKCPECGKSFSSKKH

LAEHQRTHTGEKPYKCPECGKSFSRNDTLTEHQRTHTGEKPYKCPECGKS

FSDCRDLARHQRTHTGEKPYKCPECGKSFSQSGDLRRHQRTHTGEKPYKC

PECGKSFSTKNSLTEHQRTHTGEKPTGKKTSASGSGGGSGGDALDDFDLD

MLGSDALDDFDLDMLGSDALDDFDLDMLGSDALDDFDLDMLSGGPKKKRK

VGSQYLPDTDDRHRIEEKRKRTYETFKSIMKKSPFSGPTDPRPPPRRIAV

PSRSSASVPKPAPQPYPFTSSLSTINYDEFPTMVFPSGQISQASALAPAP

PQVLPQAPAPAPAPAMVSALAQAPAPVPVLAPGPPQAVAPPAPKPTQAGE

GTLSEALLQLQFDDEDLGALLGNSTDPAVFTDLASVDNSEFQQLLNQGIP

VAPHTTEPMLMEYPEAITRLVTGAQRPPDPAPAPLGAPGLPNGLLSGDED

FSSIADMDFSALLGSGSGSRDSREGMFLPKPEAGSAISDVFEGREVCQPK

RLRPFHPPGSPWANRPLPASLAPTPTGPVHEPVGSLTPAPVPQPLDPAPA

VTPEASHLLEDPDEETSQAVKALREMADTVIPQKEEAAICGQMDLSHPPP

RGHLDELTTTLESMTEDLNLDSPLTPELNEILDTFLNDECLLHAMHISTG

LSIFDTSLFSGGKRPAATKKAGQAKKKKGSYPYDVPDYA.

In another aspect, the present invention provides a site-specific HNF4α disrupting agent, comprising a polynucleotide encoding the amino acid sequence of ZF14-VPR comprising the amino acid sequence of (SEQ ID NO: 304)
MAPKKKRKVGIHGVPAAGSSGSLEPGEKPYKCPECGKSFSTSGHLVRHQR

THTGEKPYKCPECGKSFSTTGNLTVHQRTHTGEKPYKCPECGKSFSTSGS

LVRHQRTHTGEKPYKCPECGKSFSRSDKLVRHQRTHTGEKPYKCPECGKS

FSRSDELVRHQRTHTGEKPYKCPECGKSFSRSDKLVRHQRTHTGEKPYKC

PECGKSFSQRAHLERHQRTHTGEKPTGKKTSASGSGGGSGGDALDDFDLD

MLGSDALDDFDLDMLGSDALDDFDLDMLGSDALDDFDLDMLSGGPKKKRK

VGSQYLPDTDDRHRIEEKRKRTYETFKSIMKKSPFSGPTDPRPPPRRIAV

PSRSSASVPKPAPQPYPFTSSLSTINYDEFPTMVFPSGQISQASALAPAP

PQVLPQAPAPAPAPAMVSALAQAPAPVPVLAPGPPQAVAPPAPKPTQAGE

GTLSEALLQLQFDDEDLGALLGNSTDPAVFTDLASVDNSEFQQLLNQGIP

VAPHTTEPMLMEYPEAITRLVTGAQRPPDPAPAPLGAPGLPNGLLSGDED

-continued

FSSIADMDFSALLGSGSGSRDSREGMFLPKPEAGSAISDVFEGREVCQPK

RLRPFHPPGSPWANRPLPASLAPTPTGPVHEPVGSLTPAPVPQPLDPAPA

VTPEASHLLEDPDEETSQAVKALREMADTVIPQKEEAAICGQMDLSHPPP

RGHLDELTTTLESMTEDLNLDSPLTPELNEILDTFLNDECLLHAMHISTG

LSIFDTSLFSGGKRPAATKKAGQAKKKKGSYPYDVPDYA.

In one aspect, the present invention provides a site-specific HNF4α disrupting agent, comprising a polynucleotide encoding the amino acid sequence of ZF15-VPR comprising the amino acid sequence of (SEQ ID NO: 305)
MAPKKKRKVGIHGVPAAGSSGSLEPGEKPYKCPECGKSFSRNDTLTEHQR

THTGEKPYKCPECGKSFSRNDALTEHQRTHTGEKPYKCPECGKSFSTSGE

LVRHQRTHTGEKPYKCPECGKSFSRSDNLVRHQRTHTGEKPYKCPECGKS

FSRSDELVRHQRTHTGEKPYKCPECGKSFSRSDKLVRHQRTHTGEKPYKC

PECGKSFSQSSNLVRHQRTHTGEKPTGKKTSASGSGGGSGGDALDDFDLD

MLGSDALDDFDLDMLGSDALDDFDLDMLGSDALDDFDLDMLSGGPKKKRK

VGSQYLPDTDDRHRIEEKRKRTYETFKSIMKKSPFSGPTDPRPPPRRIAV

PSRSSASVPKPAPQPYPFTSSLSTINYDEFPTMVFPSGQISQASALAPAP

PQVLPQAPAPAPAPAMVSALAQAPAPVPVLAPGPPQAVAPPAPKPTQAGE

GTLSEALLQLQFDDEDLGALLGNSTDPAVFTDLASVDNSEFQQLLNQGIP

VAPHTTEPMLMEYPEAITRLVTGAQRPPDPAPAPLGAPGLPNGLLSGDED

FSSIADMDFSALLGSGSGSRDSREGMFLPKPEAGSAISDVFEGREVCQPK

RLRPFHPPGSPWANRPLPASLAPTPTGPVHEPVGSLTPAPVPQPLDPAPA

VTPEASHLLEDPDEETSQAVKALREMADTVIPQKEEAAICGQMDLSHPPP

RGHLDELTTTLESMTEDLNLDSPLTPELNEILDTFLNDECLLHAMHISTG

LSIFDTSLFSGGKRPAATKKAGQAKKKKGSYPYDVPDYA.

In one aspect, the present invention provides a bicistronic site-specific HNF4α disrupting agent, comprising a polynucleotide encoding the amino acid sequence of a bicistronic ZF5.3-VPR-tPT2a-ZF7-VPR comprising the amino acid sequence of (SEQ ID NO: 306)
MAPKKKRKVGIHGVPAAGSSGSSGSLEPGEKPYKCPECGKSFSTSGNLTE

HQRTHTGEKPYKCPECGKSFSDSGNLRVHQRTHTGEKPYKCPECGKSFSH

KNALQNHQRTHTGEKPYKCPECGKSFSRNDTLTEHQRTHTGEKPYKCPEC

GKSFSQRAHLERHQRTHTGEKPYKCPECGKSFSRSDKLVRHQRTHTGEKP

YKCPECGKSFSDPGHLVRHQRTHTGEKPTGKKTSASGSGGGSGGDALDDF

DLDMLGSDALDDFDLDMLGSDALDDFDLDMLGSDALDDFDLDMLSGGPKK

KRKVGSQYLPDTDDRHRIEEKRKRTYETFKSIMKKSPFSGPTDPRPPPRR

IAVPSRSSASVPKPAPQPYPFTSSLSTINYDEFPTMVFPSGQISQASALA

PAPPQVLPQAPAPAPAPAMVSALAQAPAPVPVLAPGPPQAVAPPAPKPTQ

AGEGTLSEALLQLQFDDEDLGALLGNSTDPAVFTDLASVDNSEFQQLLNQ

-continued
GIPVAPHTTEPMLMEYPEAITRLVTGAQRPPDPAPAPLGAPGLPNGLLSG
DEDFSSIADMDFSALLGSGSGSRDSREGMFLPKPEAGSAISDVFEGREVC
QPKRLRPFHPPGSPWANRPLPASLAPTPTGPVHEPVGSLTPAPVPQPLDP
APAVTPEASHLLEDPDEETSQAVKALREMADTVIPQKEEAAICGQMDLSH
PPPRGHLDELTTTLESMTEDLNLDSPLTPELNEILDTFLNDECLLHAMHI
STGLSIFDTSLFSGGKRPAATKKAGQAKKKKGSYPYDVPDYAATNFSLLK
QAGDVEENPGPTSAGKLGSGEGRGSLLTCGDVEENPGPLEGSSGSGSLEP
GEKPYKCPECGKSFSRSDHLTNHQRTHTGEKPYKCPECGKSFSTSGSLVR
HQRTHTGEKPYKCPECGKSFSQAGHLASHQRTHTGEKPYKCPECGKSFSR
SDKLTEHQRTHTGEKPYKCPECGKSFSTSGNLTEHQRTHTGEKPYKCPEC
GKSFSQSSNLVRHQRTHTGEKPYKCPECGKSFSTHLDLIRHQRTHTGEKP
TGKKTSASGSGGGSGGDALDDFDLDMLGSDALDDFDLDMLGSDALDDFDL
DMLGSDALDDFDLDMLSGGPKKKRKVGSQYLPDTDDRHRIEEKRKRTYET
FKSIMKKSPFSGPTDPRPPPRRIAVPSRSSASVPKPAPQPYPFTSSLSTI
NYDEFPTMVFPSGQISQASALAPAPPQVLPQAPAPAPAPAMVSALAQAPA
PVPVLAPGPPQAVAPPAPKPTQAGEGTLSEALLQLQFDDEDLGALLGNST
DPAVFTDLASVDNSEFQQLLNQGIPVAPHTTEPMLMEYPEAITRLVTGAQ
RPPDPAPAPLGAPGLPNGLLSGDEDFSSIADMDFSALLGSGSGSRDSREG
MFLPKPEAGSAISDVFEGREVCQPKRLRPFHPPGSPWANRPLPASLAPTP
TGPVHEPVGSLTPAPVPQPLDPAPAVTPEASHLLEDPDEETSQAVKALRE
MADTVIPQKEEAAICGQMDLSHPPPRGHLDELTTTLESMTEDLNLDSPLT
PELNEILDTFLNDECLLHAMHISTGLSIFDTSLFSGGKRPAATKKAGQAK
KKKGSYPYDVPDYA.

In one aspect, the present invention provides a bicistronic site-specific HNF4α disrupting agent, comprising a polynucleotide encoding the amino acid sequence of a bicistronic ZF7-VPR-tPT2a-ZF5.3-VPR comprising the amino acid sequence of (SEQ ID NO: 178)
MAPKKKRKVGIHGVPAAGSSGSSGSLEPGEKPYKCPECGKSFSRSDHLTNHQR
THTGEKPYKCPECGKSFSTSGSLVRHQRTHTGEKPYKCPECGKSFSQAGH
LASHQRTHTGEKPYKCPECGKSFSRSDKLTEHQRTHTGEKPYKCPECGKS
FSTSGNLTEHQRTHTGEKPYKCPECGKSFSQSSNLVRHQRTHTGEKPYKC
PECGKSFSTHLDLIRHQRTHTGEKPTGKKTSASGSGGGSGGDALDDFDLD
MLGSDALDDFDLDMLGSDALDDFDLDMLSGGPKKKRK
VGSQYLPDTDDRHRIEEKRKRTYETFKSIMKKSPFSGPTDPRPPPRRIAV
PSRSSASVPKPAPQPYPFTSSLSTINYDEFPTMVFPSGQISQASALAPAP
PQVLPQAPAPAPAPAMVSALAQAPAPVPVLAPGPPQAVAPPAPKPTQAGE
GTLSEALLQLQFDDEDLGALLGNSTDPAVFTDLASVDNSEFQQLLNQGIP
VAPHTTEPMLMEYPEAITRLVTGAQRPPDPAPAPLGAPGLPNGLLSGDED
FSSIADMDFSALLGSGSGSRDSREGMFLPKPEAGSAISDVFEGREVCQPK
RLRPFHPPGSPWANRPLPASLAPTPTGPVHEPVGSLTPAPVPQPLDPAPA -continued
VTPEASHLLEDPDEETSQAVKALREMADTVIPQKEEAAICGQMDLSHPPP
RGHLDELTTTLESMTEDLNLDSPLTPELNEILDTFLNDECLLHAMHISTG
LSIFDTSLFSGGKRPAATKKAGQAKKKKGSYPYDVPDYAATNFSLLKQAG
DVEENPGPTSAGKLGSGEGRGSLLTCGDVEENPGPLEGSSGSLEPGEKPY
KCPECGKSFSTSGNLTEHQRTHTGEKPYKCPECGKSFSDSGNLRVHQRTH
TGEKPYKCPECGKSFSHKNALQNHQRTHTGEKPYKCPECGKSFSRNDTLT
EHQRTHTGEKPYKCPECGKSFSQRAHLERHQRTHTGEKPYKCPECGKSFS
RSDKLVRHQRTHTGEKPYKCPECGKSFSDPGHLVRHQRTHTGEKPTGKKT
SASGSGGGSGGDALDDFDLDMLGSDALDDFDLDMLGSDALDDFDLDMLGS
DALDDFDLDMLSGGPKKKRKVGSQYLPDTDDRHRIEEKRKRTYETFKSIM
KKSPFSGPTDPRPPPRRIAVPSRSSASVPKPAPQPYPFTSSLSTINYDEF
PTMVFPSGQISQASALAPAPPQVLPQAPAPAPAPAMVSALAQAPAPVPVL
APGPPQAVAPPAPKPTQAGEGTLSEALLQLQFDDEDLGALLGNSTDPAVF
TDLASVDNSEFQQLLNQGIPVAPHTTEPMLMEYPEAITRLVTGAQRPPDP
APAPLGAPGLPNGLLSGDEDFSSIADMDFSALLGSGSGSRDSREGMFLPK
PEAGSAISDVFEGREVCQPKRLRPFHPPGSPWANRPLPASLAPTPTGPVH
EPVGSLTPAPVPQPLDPAPAVTPEASHLLEDPDEETSQAVKALREMADTV
IPQKEEAAICGQMDLSHPPPRGHLDELTTTLESMTEDLNLDSPLTPELNE
ILDTFLNDECLLHAMHISTGLSIFDTSLFSGGKRPAATKKAGQAKKKKGS
YPYDVPDYA.

In one aspect, the present invention provides a bicistronic site-specific HNF4α disrupting agent, comprising a polynucleotide encoding the amino acid sequence of a bicistronic ZF5.3-VPR-tPT2a-ZF7-p300 comprising the amino acid sequence of (SEQ ID NO: 307)
MAPKKKRKVGIHGVPAAGSSGSSGSLEPGEKPYKCPECGKSFSTSGNLTE
HQRTHTGEKPYKCPECGKSFSDSGNLRVHQRTHTGEKPYKCPECGKSFSH
KNALQNHQRTHTGEKPYKCPECGKSFSRNDTLTEHQRTHTGEKPYKCPEC
GKSFSQRAHLERHQRTHTGEKPYKCPECGKSFSRSDKLVRHQRTHTGEKP
YKCPECGKSFSDPGHLVRHQRTHTGEKPTGKKTSASGSGGGSGGDALDDF
DLDMLGSDALDDFDLDMLGSDALDDFDLDMLGSDALDDFDLDMLSGGPKK
KRKVGSQYLPDTDDRHRIEEKRKRTYETFKSIMKKSPFSGPTDPRPPPRR
IAVPSRSSASVPKPAPQPYPFTSSLSTINYDEFPTMVFPSGQISQASALA
PAPPQVLPQAPAPAPAPAMVSALAQAPAPVPVLAPGPPQAVAfPPAPKPT
QAGEGTLSEALLQLQFDDEDLGALLGNSTDPAVFTDLASVDNSEFQQLLN
QGIPVAPHTTEPMLMEYPEAITRLVTGAQRPPDPAPAPLGAPGLPNGLLS
GDEDFSSIADMDFSALLGSGSGSRDSREGMFLPKPEAGSAISDVFEGREV
CQPKRLRPFHPPGSPWANRPLPASLAPTPTGPVHEPVGSLTPAPVPQPLD
PAPAVTPEASHLLEDPDEETSQAVKALREMADTVIPQKEEAAICGQMDLS
HPPPRGHLDELTTTLESMTEDLNLDSPLTPELNEILDTFLNDECLLHAMH -continued
ISTGLSIFDTSLFSGGKRPAATKKAGQAKKKKGSYPYDVPDYAATNFSLL

KQAGDVEENPGPTSAGKLGSGEGRGSLLTCGDVEENPGPLEGSSGSGSLE

PGEKPYKCPECGKSFSRSDHLTNHQRTHTGEKPYKCPECGKSFSTSGSLV

RHQRTHTGEKPYKCPECGKSFSQAGHLASHQRTHTGEKPYKCPECGKSFS

RSDKLTEHQRTHTGEKPYKCPECGKSFSTSGNLTEHQRTHTGEKPYKCPE

CGKSFSQSSNLVRHQRTHTGEKPYKCPECGKSFSTHLDLIRHQRTHTGEK

PTGKKTSASGSGGGSGGIFKPEELRQALMPTLEALYRQDPESLPFRQPVD

PQLLGIPDYFDIVKSPMDLSTIKRKLDTGQYQEPWQYVDDIWLMFNNAWL

YNRKTSRVYKYCSKLSEVFEQEIDPVMQSLGYCCGRKLEFSPQTLCCYGK

QLCTIPRDATYYSYQNRYHFCEKCFNEIQGESVSLGDDPSQPQTTINKEQ

FSKRKNDTLDPELFVECTECGRKMHQICVLHHEIIWPAGFVCDGCLKKSA

RTRKENKFSAKRLPSTRLGTFLENRVNDFLRRQNHPESGEVTVRVVHASD

KTVEVKPGMKARFVDSGEMAESFPYRTKALFAFEEIDGVDLCFFGMHVQE

YGSDCPPPNQRRVYISYLDSVHFFRPKCLRTAVYHEILIGYLEYVKKLGY

TTGHIWACPPSEGDDYIFHCHPPDQKIPKPKRLQEWYKKMLDKAVSERIV

HDYKDIFKQATEDRLTSAKELPYFEGDFWPNVLEESIKELEQEEEERKRE

ENTSNESTDVTKGDSKNAKKKNNKKTSKNKSSLSRGNKKKPGMPNVSNDL

SQKLYATMEKHKEVFFVIRLIAGPAANSLPPIVDPDPLIPCDLMDGRDAF

LTLARDKHLEFSSLRRAQWSTMCMLVELHTQSQDSGGKRPAATKKAGQAK

KKKGSYPYDVPDYA.

In one aspect, the present invention provides a bicistronic site-specific HNF4α disrupting agent, comprising a polynucleotide encoding the amino acid sequence of a bicistronic ZF7-p300-tPT2a-ZF5.3-VPR comprising the amino acid sequence of (SEQ ID NO: 308)
MAPKKKRKVGIHGVPAAGSSGSLEPGEKPYKCPECGKSFSRSDHLTNHQR

THTGEKPYKCPECGKSFSTSGSLVRHQRTHTGEKPYKCPECGKSFSQAGH

LASHQRTHTGEKPYKCPECGKSFSRSDKLTEHQRTHTGEKPYKCPECGKS

FSTSGNLTEHQRTHTGEKPYKCPECGKSFSQSSNLVRHQRTHTGEKPYKC

PECGKSFSTHLDLIRHQRTHTGEKPTGKKTSASGSGGGSGGIFKPEELRQ

ALMPTLEALYRQDPESLPFRQPVDPQLLGIPDYFDIVKSPMDLSTIKRKL

DTGQYQEPWQYVDDIWLMFNNAWLYNRKTSRVYKYCSKLSEVFEQEIDPV

MQSLGYCCGRKLEFSPQTLCCYGKQLCTIPRDATYYSYQNRYHFCEKCFN

EIQGESVSLGDDPSQPQTTINKEQFSKRKNDTLDPELFVECTECGRKMHQ

ICVLHHEIIWPAGFVCDGCLKKSARTRKENKFSAKRLPSTRLGTFLENRV

NDFLRRQNHPESGEVTVRVVHASDKTVEVKPGMKARFVDSGEMAESFPYR

TKALFAFEEIDGVDLCFFGMHVQEYGSDCPPPNQRRVYISYLDSVHFFRP

KCLRTAVYHEILIGYLEYVKKLGYTTGHIWACPPSEGDDYIFHCHPPDQK

IPKPKRLQEWYKKMLDKAVSERIVHDYKDIFKQATEDRLTSAKELPYFEG

DFWPNVLEESIKELEQEEEERKREENTSNESTDVTKGDSKNAKKKNNKKT

SKNKSSLSRGNKKKPGMPNVSNDLSQKLYATMEKHKEVFFVIRLIAGPAA

-continued
NSLPPIVDPDPLIPCDLMDGRDAFLTLARDKHLEFSSLRRAQWSTMCMLV

ELHTQSQDSGGKRPAATKKAGQAKKKKGSYPYDVPDYAATNFSLLKQAGD

VEENPGPTSAGKLGSGEGRGSLLTCGDVEENPGPLEGSSGSLEPGEKPYK

CPECGKSFSTSGNLTEHQRTHTGEKPYKCPECGKSFSDSGNLRVHQRTHT

GEKPYKCPECGKSFSHKNALQNHQRTHTGEKPYKCPECGKSFSRNDTLTE

HQRTHTGEKPYKCPECGKSFSQRAHLERHQRTHTGEKPYKCPECGKSFSR

SDKLVRHQRTHTGEKPYKCPECGKSFSDPGHLVRHQRTHTGEKPTGKKTS

ASGSGGGSGGDALDDFDLDMLGSDALDDFDLDMLGSDALDDFDLDMLGSD

ALDDFDLDMLSGGPKKKRKVGSQYLPDTDDRHRIEEKRKRTYETFKSIMK

KSPFSGPTDPRPPPRRIAVPSRSSASVPKPAPQPYPFTSSLSTINYDEFP

TMVFPSGQISQASALAPAPPQVLPQAPAPAPAPAMVSALAQAPAPVPVLA

PGPPQAVAPPAPKPTQAGEGTLSEALLQLQFDDEDLGALLGNSTDPAVFT

DLASVDNSEFQQLLNQGIPVAPHTTEPMLMEYPEAITRLVTGAQRPPDPA

PAPLGAPGLPNGLLSGDEDFSSIADMDFSALLGSGSGSRDSREGMFLPKP

EAGSAISDVFEGREVCQPKRLRPFHPPGSPWANRPLPASLAPTPTGPVHE

PVGSLTPAPVPQPLDPAPAVTPEASHLLEDPDEETSQAVKALREMADTVI

PQKEEAAICGQMDLSHPPPRGHLDELTTTLESMTEDLNLDSPLTPELNEI

LDTFLNDECLLHAMHISTGLSIFDTSLFSGGKRPAATKKAGQAKKKKGSY

PYDVPDYA.

The present invention also provides vectors, such as viral expression vectors and cells comprising the site-specific HNF4α disrupting agents of the invention as well as the vectors of the invention.

In some embodiments, the site-specific HNF4α disrupting agents of the invention are present in a composition, such as a pharmaceutical composition.

In some embodiments, the pharmaceutical composition comprises a lipid formulation.

In some embodiments, the lipid formulation comprises one or more cationic lipids, one or more non-cationic lipids, one or more cholesterol-based lipids, or one or more PEG-modified lipids, or combinations of any of the foregoing.

In some embodiments, the pharmaceutical composition comprises a lipid nanoparticle.

In one aspect, the present invention provides a pharmaceutical composition comprising a site-specific HNF4α disrupting agent, comprising a polynucleotide encoding the amino acid sequence of ZF5.3-VPR comprising the amino acid sequence of (SEQ ID NO: 301)
MAPKKKRKVGIHGVPAAGSSGSLEPGEKPYKCPECGKSFSTSGNLTEHQR

THTGEKPYKCPECGKSFSDSGNLRVHQRTHTGEKPYKCPECGKSFSHKNA

LQNHQRTHTGEKPYKCPECGKSFSRNDTLTEHQRTHTGEKPYKCPECGKS

FSQRAHLERHQRTHTGEKPYKCPECGKSFSRSDKLVRHQRTHTGEKPYKC

PECGKSFSDPGHLVRHQRTHTGEKPTGKKTSASGSGGGSGGDALDDFDLD

MLGSDALDDFDLDMLGSDALDDFDLDMLGSDALDDFDLDMLSGGPKKKRK

VGSQYLPDTDDRHRIEEKRKRTYETFKSIMKKSPFSGPTDPRPPPRRIAV

PSRSSASVPKPAPQPYPFTSSLSTINYDEFPTMVFPSGQISQASALAPAP

PQVLPQAPAPAPAPAMVSALAQAPAPVPVLAPGPPQAVAPPAPKPTQAGE

GTLSEALLQLQFDDEDLGALLGNSTDPAVFTDLASVDNSEFQQLLNQGIP

VAPHTTEPMLMEYPEAITRLVTGAQRPPDPAPAPLGAPGLPNGLLSGDED

FSSIADMDFSALLGSGSGSRDSREGMFLPKPEAGSAISDVFEGREVCQPK

RLRPFHPPGSPWANRPLPASLAPTPTGPVHEPVGSLTPAPVPQPLDPAPA

VTPEASHLLEDPDEETSQAVKALREMADTVIPQKEEAAICGQMDLSHPPP

RGHLDELTTTLESMTEDLNLDSPLTPELNEILDTFLNDECLLHAMHISTG

LSIFDTSLFSGGKRPAATKKAGQAKKKKGSYPYDVPDYA, and a lipid nanoparticle.

In one aspect, the present invention provides a pharmaceutical composition comprising a site-specific HNF4α disrupting agent, comprising a polynucleotide encoding the amino acid sequence of ZF5.3-VPR comprising the amino acid sequence of (SEQ ID NO: 301)
MAPKKKRKVGIHGVPAAGSSGSLEPGEKPYKCPECGKSFSTSGNLTEHQR

THTGEKPYKCPECGKSFSDSGNLRVHQRTHTGEKPYKCPECGKSFSHKNA

LQNHQRTHTGEKPYKCPECGKSFSRNDTLTEHQRTHTGEKPYKCPECGKS

FSQRAHLERHQRTHTGEKPYKCPECGKSFSRSDKLVRHQRTHTGEKPYKC

PECGKSFSDPGHLVRHQRTHTGEKPTGKKTSASGSGGGSGGDALDDFDLD

MLGSDALDDFDLDMLGSDALDDFDLDMLGSDALDDFDLDMLSGGPKKKRK

VGSQYLPDTDDRHRIEEKRKRTYETFKSIMKKSPFSGPTDPRPPPRRIAV

PSRSSASVPKPAPQPYPFTSSLSTINYDEFPTMVFPSGQISQASALAPAP

PQVLPQAPAPAPAPAMVSALAQAPAPVPVLAPGPPQAVAPPAPKPTQAGE

GTLSEALLQLQFDDEDLGALLGNSTDPAVFTDLASVDNSEFQQLLNQGIP

VAPHTTEPMLMEYPEAITRLVTGAQRPPDPAPAPLGAPGLPNGLLSGDED

FSSIADMDFSALLGSGSGSRDSREGMFLPKPEAGSAISDVFEGREVCQPK

RLRPFHPPGSPWANRPLPASLAPTPTGPVHEPVGSLTPAPVPQPLDPAPA

VTPEASHLLEDPDEETSQAVKALREMADTVIPQKEEAAICGQMDLSHPPP

RGHLDELTTTLESMTEDLNLDSPLTPELNEILDTFLNDECLLHAMHISTG

LSIFDTSLFSGGKRPAATKKAGQAKKKKGSYPYDVPDYA;

and
a site-specific HNF4α disrupting agent, comprising a polynucleotide encoding the amino acid sequence of ZF7-VPR comprising the amino acid sequence of (SEQ ID NO: 302)
MAPKKKRKVGIHGVPAAGSSGSLEPGEKPYKCPECGKSFSRSDHLTNHQR

THTGEKPYKCPECGKSFSTSGSLVRHQRTHTGEKPYKCPECGKSFSQAGH

LASHQRTHTGEKPYKCPECGKSFSRSDKLTEHQRTHTGEKPYKCPECGKS

FSTSGNLTEHQRTHTGEKPYKCPECGKSFSQSSNLVRHQRTHTGEKPYKC

PECGKSFSTHLDLIRHQRTHTGEKPTGKKTSASGSGGGSGGDALDDFDLD

MLGSDALDDFDLDMLGSDALDDFDLDMLGSDALDDFDLDMLSGGPKKKRK

VGSQYLPDTDDRHRIEEKRKRTYETFKSIMKKSPFSGPTDPRPPPRRIAV

PSRSSASVPKPAPQPYPFTSSLSTINYDEFPTMVFPSGQISQASALAPAP

PQVLPQAPAPAPAPAMVSALAQAPAPVPVLAPGPPQAVAPPAPKPTQAGE

GTLSEALLQLQFDDEDLGALLGNSTDPAVFTDLASVDNSEFQQLLNQGIP

VAPHTTEPMLMEYPEAITRLVTGAQRPPDPAPAPLGAPGLPNGLLSGDED

FSSIADMDFSALLGSGSGSRDSREGMFLPKPEAGSAISDVFEGREVCQPK

RLRPFHPPGSPWANRPLPASLAPTPTGPVHEPVGSLTPAPVPQPLDPAPA

VTPEASHLLEDPDEETSQAVKALREMADTVIPQKEEAAICGQMDLSHPPP

RGHLDELTTTLESMTEDLNLDSPLTPELNEILDTFLNDECLLHAMHISTG

LSIFDTSLFSGGKRPAATKKAGQAKKKKGSYPYDVPDYA;

and a lipid nanoparticle.

In one aspect, the present invention provides a pharmaceutical composition, comprising a site-specific HNF4α disrupting agent, comprising a polynucleotide encoding the amino acid sequence of a bicistronic ZF5.3-VPR-tPT2a-ZF7-VPR comprising the amino acid sequence of (SEQ ID NO: 306)
MAPKKKRKVGIHGVPAAGSSGSSGSLEPGEKPYKCPECGKSFSTSGNLTE

HQRTHTGEKPYKCPECGKSFSDSGNLRVHQRTHTGEKPYKCPECGKSFSH

KNALQNHQRTHTGEKPYKCPECGKSFSRNDTLTEHQRTHTGEKPYKCPEC

GKSFSQRAHLERHQRTHTGEKPYKCPECGKSFSRSDKLVRHQRTHTGEKP

YKCPECGKSFSDPGHLVRHQRTHTGEKPTGKKTSASGSGGGSGGDALDDF

DLDMLGSDALDDFDLDMLGSDALDDFDLDMLGSDALDDFDLDMLSGGPKK

KRKVGSQYLPDTDDRHRIEEKRKRTYETFKSIMKKSPFSGPTDPRPPPRR

IAVPSRSSASVPKPAPQPYPFTSSLSTINYDEFPTMVFPSGQISQASALA

PAPPQVLPQAPAPAPAPAMVSALAQAPAPVPVLAPGPPQAVAPPAPKPTQ

AGEGTLSEALLQLQFDDEDLGALLGNSTDPAVFTDLASVDNSEFQQLLNQ

GIPVAPHTTEPMLMEYPEAITRLVTGAQRPPDPAPAPLGAPGLPNGLLSG

DEDFSSIADMDFSALLGSGSGSRDSREGMFLPKPEAGSAISDVFEGREVC

QPKRLRPFHPPGSPWANRPLPASLAPTPTGPVHEPVGSLTPAPVPQPLDP

APAVTPEASHLLEDPDEETSQAVKALREMADTVIPQKEEAAICGQMDLSH

PPPRGHLDELTTTLESMTEDLNLDSPLTPELNEILDTFLNDECLLHAMHI

STGLSIFDTSLFSGGKRPAATKKAGQAKKKKGSYPYDVPDYAATNFSLLK

QAGDVEENPGPTSAGKLGSGEGRGSLLTCGDVEENPGPLEGSSGSGSLEP

GEKPYKCPECGKSFSRSDHLTNHQRTHTGEKPYKCPECGKSFSTSGSLVR

HQRTHTGEKPYKCPECGKSFSQAGHLASHQRTHTGEKPYKCPECGKSFSR

SDKLTEHQRTHTGEKPYKCPECGKSFSTSGNLTEHQRTHTGEKPYKCPEC

GKSFSQSSNLVRHQRTHTGEKPYKCPECGKSFSTHLDLIRHQRTHTGEKP

TGKKTSASGSGGGSGGDALDDFDLDMLGSDALDDFDLDMLGSDALDDFDL

DMLGSDALDDFDLDMLSGGPKKKRKVGSQYLPDTDDRHRIEEKRKRTYET

FKSIMKKSPFSGPTDPRPPPRRIAVPSRSSASVPKPAPQPYPFTSSLSTI

NYDEFPTMVFPSGQISQASALAPAPPQVLPQAPAPAPAPAMVSALAQAPA

-continued

PVPVLAPGPPQAVAPPAPKPTQAGEGTLSEALLQLQFDDEDLGALLGNST

DPAVFTDLASVDNSEFQQLLNQGIPVAPHTTEPMLMEYPEAITRLVTGAQ

RPPDPAPAPLGAPGLPNGLLSGDEDFSSIADMDFSALLGSGSGSRDSREG

MFLPKPEAGSAISDVFEGREVCQPKRLRPFHPPGSPWANRPLPASLAPTP

TGPVHEPVGSLTPAPVPQPLDPAPAVTPEASHLLEDPDEETSQAVKALRE

MADTVIPQKEEAAICGQMDLSHPPPRGHLDELTTTLESMTEDLNLDSPLT

PELNEILDTFLNDECLLHAMHISTGLSIFDTSLFSGGKRPAATKKAGQAK

KKKGSYPYDVPDYA;

and a lipid nanoparticle.

In one aspect, the present invention provides a method of modulating expression of hepatocyte nuclear factor 4 alpha- (HNF4α) in a cell. The method includes contacting the cell with a site-specific HNF4α disrupting agent, the disrupting agent comprising a site-specific HNF4α targeting moiety which targets an HNF4α expression control region, and an effector molecule, thereby modulating expression of HNF4α in the cell.

The modulation of expression may be enhanced expression of HNF4α in the cell or reduced expression of HNF4α in the cell.

BRIEF DESCRIPTION OF THE DRAWINGS

FIG. 9 discloses SEQ ID NOS 2526-2527, and 2519-2525, respectively, in order of appearance.

DETAILED DESCRIPTION OF THE INVENTION

Figure 1:
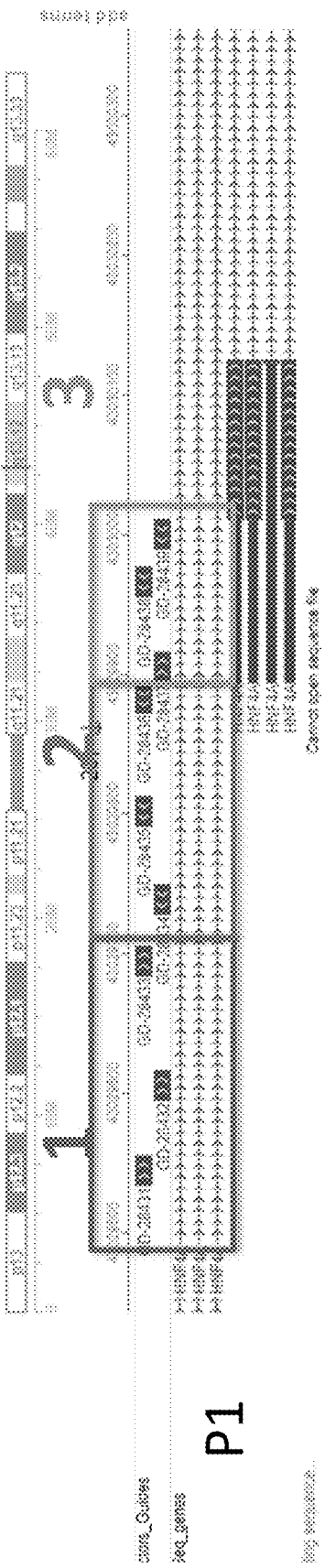
FIG. 1 depicts a chromosomal view of a portion of the upstream region and coding sequence of HNF4α and the positions of guide RNAs and pools of guide RNAs described herein.

The present invention provides agents and compositions for modulating expression (e.g., enhanced or reduced expression) of a hepatocyte nuclear factor 4 alpha (HNF4α) gene by targeting an HNF4α expression control region. The HNF4α gene may be in a cell, e.g., a mammalian cell, such as a mammalian somatic cell, e.g., a human somatic cell. The present invention also provides methods of using the agents and compositions of the invention for modulating the expression of an HNF4α gene or for treating a subject who would benefit from modulating the expression of an HNF4α gene, e.g., a subject suffering or prone to suffering from an HNF4α-associated disease.

The agents of the invention are referenced to herein as site-specific HNF4α disrupting agents and are described in Section II, below.

I. Definitions

In order that the present invention may be more readily understood, certain terms are first defined. In addition, it should be noted that whenever a value or range of values of a parameter are recited, it is intended that values and ranges intermediate to the recited values are also intended to be part of this invention.

The articles "a" and "an" are used herein to refer to one or to more than one (i.e., to at least one) of the grammatical object of the article. By way of example, "an element" means one element or more than one element, e.g., a plurality of elements.

The term "including" is used herein to mean, and is used interchangeably with, the phrase "including but not limited to". The term "or" is used herein to mean, and is used interchangeably with, the term "and/or," unless context clearly indicates otherwise.

The term "about" is used herein to mean within the typical ranges of tolerances in the art. For example, "about" can be understood as about 2 standard deviations from the mean. In certain embodiments, about means±10%. In certain embodiments, about means±5%. When about is present before a series of numbers or a range, it is understood that "about" can modify each of the numbers in the series or range.

The term "at least" prior to a number or series of numbers is understood to include the number adjacent to the term "at least", and all subsequent numbers or integers that could logically be included, as clear from context. For example, the number of nucleotides in a nucleic acid molecule must be an integer. For example, "at least 18 nucleotides of a 21 nucleotide nucleic acid molecule" means that 18, 19, 20, or 21 nucleotides have the indicated property. When at least is present before a series of numbers or a range, it is understood that "at least" can modify each of the numbers in the series or range.

As used herein, "no more than" or "less than" is understood as the value adjacent to the phrase and logical lower values or integers, as logical from context, to zero. When "no more than" is present before a series of numbers or a range, it is understood that "no more than" can modify each of the numbers in the series or range.

As used herein, the term "substantially" refers to the qualitative condition of exhibiting total or near-total extent or degree of a characteristic or property of interest. One of ordinary skill in the art will understand that biological and chemical phenomena rarely, if ever, go to completion and/or proceed to completeness or achieve or avoid an absolute result. The term "substantially" may therefore be used in some embodiments herein to capture potential lack of completeness inherent in many biological and chemical phenomena.

As used herein, the terms "hepatocyte nuclear factor 4 alpha," "HNF4α," and "HNF4A," as used interchangeably herein, refer to the gene as well as the well known encoded protein which is a nuclear transcription factor which binds DNA as a homodimer. The encoded protein controls the expression of several genes, including hepatocyte nuclear factor 1 alpha, a transcription factor which regulates the expression of several hepatic genes. HNF4α also plays a role in development of the liver, kidney, and intestines. Decreased expression of this gene has been associated with monogenic autosomal dominant non-insulin-dependent diabetes mellitus type I (MODY I) and liver disease, e.g., cirrhosis. Dysregulated, e.g., increased, expression of this gene has been associated with hepatocellular carcinoma. The nucleotide and amino acid sequence of HNF4α is known and may be found in, for example, GenBank Accession Nos. NM_000457; NM_175914; NM_178849; NM_178850; NM_001030003; NM_001030004; NM_001258355; NM_001287182; NM_001287183; NM_001287184; XM_005260407; NP_000448.3; NP_787110.2; NP_849180.1; NP_849181.1; NP_001025174.1; NP_001025175.1; NP_001245284.1; NP_001274111.1; NP_001274112.1; NP_001274113.1; XP_005260464.1, the entire contents of each of which are incorporated herein by reference. The nucleotide sequence of the genomic region of Chromosome 20 which includes the endogenous promoters of HNF4α and the HNF4α coding sequence is also known and may be found in GenBank Accession No. NC_000020.10 (42984441 . . . 43061485).

Figure 8:
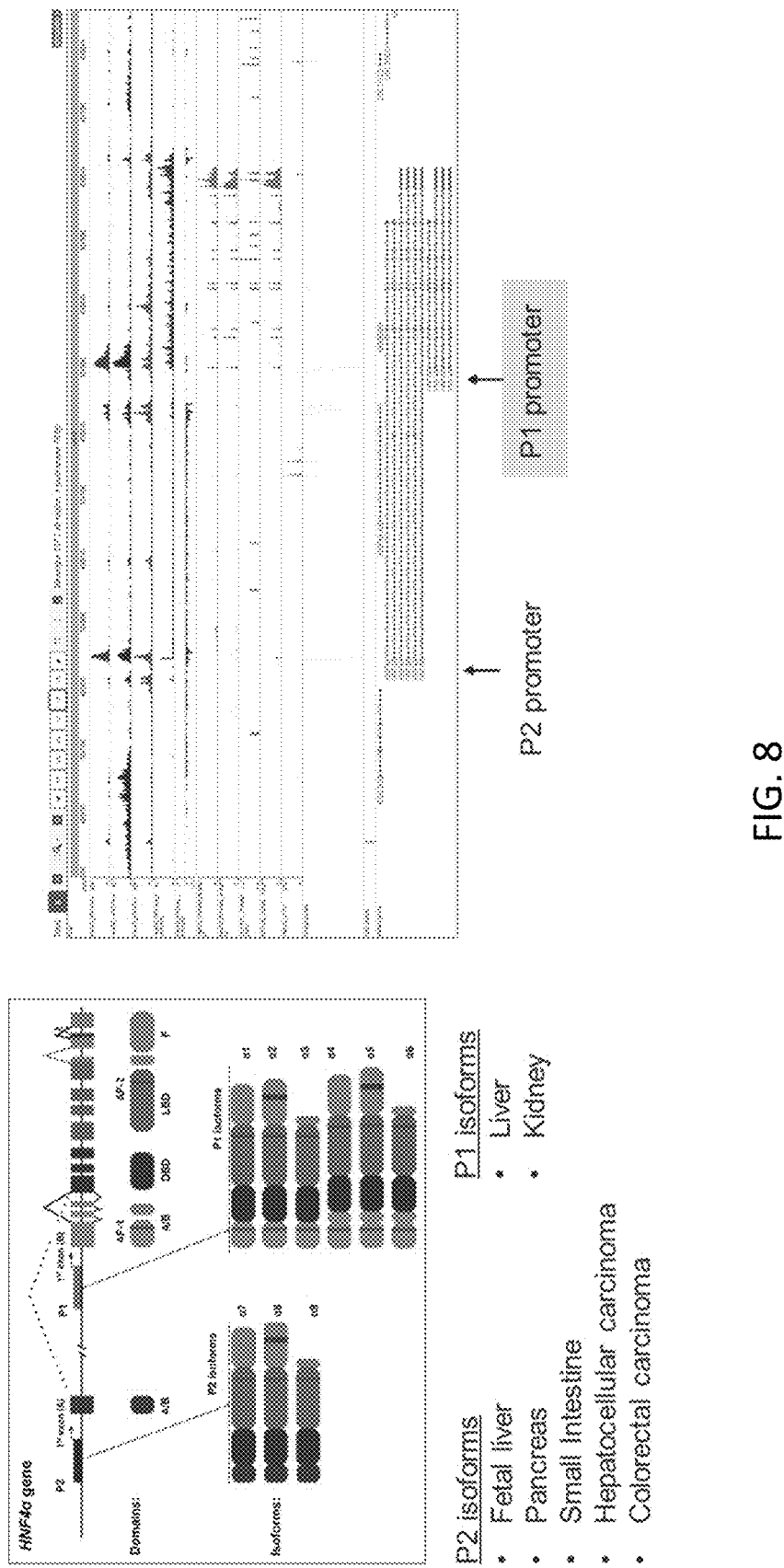
FIG. 8 is a schematic depicting the structure of the human HNF4α promoter region and the isoforms of HNF4α.

The HNF4α gene is located on chromosome 20, with transcription regulated by two promoters (P1 and P2) and alternative splicing variants, resulting in nine distinct isoforms (α1-α9) (FIG. 8). The HNF4α locus is transcriptionally regulated through the use of two distinct promoters that are physically separated by more than 45 kb. Isoforms produced by the activity of the closer promoter are designated P1 whereas isoforms produced by the second and more distant promoter are designated P2. Isoforms most common in the liver are expressed from promoter 1 (P1), with isoforms from P2 most commonly found in fetal tissues, and in the adult kidney and small intestine.

HNF4α controls the expression of proteins necessary for the normal function of hepatocytes and other cell types in the liver. (Argemi J, et al. Defective HNF4alpha-dependent gene expression as a driver of hepatocellular failure in alcoholic hepatitis. Nat Commun. 2019; 10(1):3126. doi: 10.1038/s41467-019-11004-3; Nishikawa T, et al. Resetting the transcription factor network reverses terminal chronic hepatic failure. J Clin Invest. 2015; 125(4):1533-1544. doi: 10.1172/JCI73137). In addition, many of these proteins are secreted by liver cells and contribute to health systemically. For example, proteins such as albumin are required to transport nutrients, hormones, lipids, and small molecule drugs in the circulation.

The term "site-specific HNF4α disrupting agent," as used herein, refers to any agent that specifically binds to a target HNF4α expression control region and, e.g., modulates expression of an HNF4α gene. The modulation of expression may be permanent or transient modulation. Site-specific HNF4α disruption agents of the invention may comprise a "site-specific HNF4α targeting moiety."

As used herein, the term "site-specific HNF4α targeting moiety" refers to a moiety that specifically binds to an HNF4α expression control region, e.g., a transcriptional control region of an HNF4α gene, such as a promoter, an enhancer, or a repressor; or an HNF4α-associated anchor sequence, such as, for example within an HNF4α-associated anchor sequence-mediated conjunction. Exemplary "site-specific HNF4α targeting moieties" include, but are not limited to, polyamides, nucleic acid molecules, such as RNA, DNA, or modified RNA or DNA, polypeptides, protein nucleic acid molecules, and fusion proteins.

As used herein, the terms "specific binding" or "specifically binds" refer to an ability to discriminate between possible binding partners in the environment in which binding is to occur. In some embodiments, a disrupting agent that interacts, e.g., preferentially interacts, with one particular target when other potential disrupting agents are present is said to "bind specifically" to the target (i.e., the expression control region) with which it interacts. In some embodiments, specific binding is assessed by detecting or determining the degree of association between the disrupting agent and its target; in some embodiments, specific binding is assessed by detecting or determining degree of dissociation of a disrupting agent-target complex. In some embodiments, specific binding is assessed by detecting or determining ability of the disrupting agent to compete with an alternative interaction between its target and another entity. In some embodiments, specific binding is assessed by performing such detections or determinations across a range of concentrations.

As used herein, the term "expression control region" or expression control domain' refers to a region or domain present in a genomic DNA that modulates the expression of a target gene in a cell. A functionality associated with an expression control region may directly affect expression of a target gene, e.g., by recruiting or blocking recruitment of a transcription factor that would stimulate expression of the gene. A functionality associated with an expression control region may indirectly affect expression of a target gene, e.g., by introducing epigenetic modifications or recruiting other factors that introduce epigenetic modifications that induce a change in chromosomal topology that modulates expression of a target gene. Expression control regions may be upstream and/or downstream of the protein coding sequence of a gene and include, for example, transcriptional control elements, e.g., promoters, enhancers, or repressors; and anchor sequences, and anchor sequence-mediated conjunctions.

The term "transcriptional control element," as used herein, refers to a nucleic acid sequence that controls transcription of a gene. Transcriptional control elements include, for example, anchor sequences, anchor sequence-mediated conjunctions, promoters, transcriptional enhancers, and transcriptional repressors.

A promoter is a region of DNA recognized by an RNA polymerase to initiate transcription of a particular gene and is generally located upstream of the 5'-end of the transcription start site of the gene.

A "transcriptional enhancer" increases gene transcription. A "transcriptional silencer" or "transcriptional repressor" decreases gene transcription. Enhancing and silencing sequences may be about 50-3500 base pairs in length and may influence gene transcription up to about 1 megabases away.

The term "gene," as used herein, refers to a sequence of nucleotides that encode a molecule, such as a protein, that has a function. A gene contains sequences that are transcribed (e.g., a 3'UTR), sequences that are not transcribed (e.g., a promoter), sequences that are translated (e.g., an exon), and sequences that are not translated (e.g., intron).

As used herein, the term "target gene" means an HNF4α gene that is targeted for modulation, e.g., increase or decrease, of expression. In some embodiments, an HNF4α target gene is part of a targeted genomic complex (e.g. an HNF4α gene that has at least part of its genomic sequence as part of a target genomic complex, e.g. inside an anchor sequence-mediated conjunction), which genomic complex is targeted by one or more site-specific disrupting agents as described herein. In some embodiments, modulation comprises inhibition of expression of the target gene. In some embodiments, an HNF4α gene is modulated by contacting the HNF4α gene or a transcription control element operably linked to the HNF4α gene with one or more site-specific disrupting agents as described herein. In some embodiments, an HNF4α gene is aberrantly expressed (e.g., over-expressed) in a cell, e.g., a cell in a subject (e.g., a subject having an HNF4α-associated disease). In some embodiments, an HNF4α gene is aberrantly expressed (e.g., under-expressed) in a cell, e.g., a cell in a subject (e.g., a subject having an HNF4α-associated disease).

The term "anchor sequence" as used herein, refers to a nucleic acid sequence recognized by a nucleating agent that binds sufficiently to form an anchor sequence-mediated conjunction, e.g., a complex. In some embodiments, an anchor sequence comprises one or more CTCF binding motifs. In some embodiments, an anchor sequence is not located within a gene coding region. In some embodiments, an anchor sequence is located within an intergenic region. In some embodiments, an anchor sequence is not located within either of an enhancer or a promoter. In some embodiments, an anchor sequence is located at least 400 bp, at least 450 bp, at least 500 bp, at least 550 bp, at least 600 bp, at least 650 bp, at least 700 bp, at least 750 bp, at least 800 bp, at least 850 bp, at least 900 bp, at least 950 bp, or at least 1 kb away from any transcription start site. In some embodiments, an anchor sequence is located within a region that is not associated with genomic imprinting, monoallelic expression, and/or monoallelic epigenetic marks. In some embodiments, the anchor sequence has one or more functions selected from binding an endogenous nucleating polypeptide (e.g., CTCF), interacting with a second anchor sequence to form an anchor sequence mediated conjunction, or insulating against an enhancer that is outside the anchor sequence mediated conjunction. In some embodiments of the present invention, technologies are provided that may specifically target a particular anchor sequence or anchor sequences, without targeting other anchor sequences (e.g., sequences that may contain a nucleating agent (e.g., CTCF) binding motif in a different context); such targeted anchor sequences may be referred to as the "target anchor sequence". In some embodiments, sequence and/or activity of a target anchor sequence is modulated while sequence and/or activity of one or more other anchor sequences that may be present in the same system (e.g., in the same cell and/or in some embodiments on the same nucleic acid molecule, e.g., the same chromosome) as the other targeted anchor sequence is not modulated. In some embodiments, the anchor sequence comprises or is a nucleating polypeptide binding motif. In some embodiments, the anchor sequence is adjacent to a nucleating polypeptide binding motif.

The term "anchor sequence-mediated conjunction" as used herein, refers to a DNA structure, in some cases, a complex, that occurs and/or is maintained via physical interaction or binding of at least two anchor sequences in the DNA by one or more polypeptides, such as nucleating polypeptides, or one or more proteins and/or a nucleic acid entity (such as RNA or DNA), that bind the anchor sequences to enable spatial proximity and functional linkage between the anchor sequences.

As used herein, the term "genomic complex" is a complex that brings together two genomic sequence elements that are spaced apart from one another on one or more chromosomes, via interactions between and among a plurality of protein and/or other components (potentially including, the genomic sequence elements). In some embodiments, the genomic sequence elements are anchor sequences to which one or more protein components of the complex bind. In some embodiments, a genomic complex may comprise an anchor sequence-mediated conjunction. In some embodiments, a genomic sequence element may be or comprise a CTCF binding motif, a promoter and/or an enhancer. In some embodiments, a genomic sequence element includes at least one or both of a promoter and/or regulatory region (e.g., an enhancer). In some embodiments, complex formation is nucleated at the genomic sequence element(s) and/or by binding of one or more of the protein component(s) to the genomic sequence element(s). As will be understood by those skilled in the art, in some embodiments, co-localization (e.g., conjunction) of the genomic sites via formation of the complex alters DNA topology at or near the genomic sequence element(s), including, in some embodiments, between them. In some embodiments, a genomic complex comprises an anchor sequence-mediated conjunction, which comprises one or more loops. In some embodiments, a genomic complex as described herein is nucleated by a nucleating polypeptide such as, for example, CTCF and/or Cohesin. In some embodiments, a genomic complex as described herein may include, for example, one or more of CTCF, Cohesin, non-coding RNA (e.g., eRNA), transcriptional machinery proteins (e.g., RNA polymerase, one or more transcription factors, for example selected from the group consisting of TFIIA, TFIIB, TFIID, TFIIE, TFIIF, TFIIH, etc.), transcriptional regulators (e.g., Mediator, P300, enhancer-binding proteins, repressor-binding proteins, histone modifiers, etc.), etc. In some embodiments, a genomic complex as described herein includes one or more polypeptide components and/or one or more nucleic acid components (e.g., one or more RNA components), which may, in some embodiments, be interacting with one another and/or with one or more genomic sequence elements (e.g., anchor sequences, promoter sequences, regulatory sequences (e.g., enhancer sequences)) so as to constrain a stretch of genomic DNA into a topological configuration (e.g., a loop) that the stretch of genomic DNA does not adopt when the complex is not formed.

An "effector molecule," as used herein, refers to a molecule that is able to regulate a biological activity, such as enzymatic activity, gene expression, anchor sequence-mediated conjunction or cell signaling. Exemplary effectors are described in Section II, below, and in some embodiment include, for example, nucleases, physical blockers, epigenetic recruiters, e.g., a transcriptional enhancer or a transcriptional repressor, and epigenetic CpG modifiers, e.g., a DNA methylase, a DNA demethylase, a histone modifying agent, or a histone deacetylase, and combinations of any of the foregoing.

II. Site-Specific HNF4α Disrupting Agents of the Invention

The present invention provides site-specific HNF4α disrupting agents which, in one aspect of the invention include a site-specific HNF4α targeting moiety which targets an HNF4α expression control region. In another aspect, the site-specific disrupting agents of the invention include a site-specific HNF4α targeting moiety which targets an HNF4α expression control region and an effector molecule. As will be appreciated by one of ordinary skill in the art, such disrupting agents are site-specific and, thus, specifically bind to an HNF4α expression control region (e.g., one or more transcriptional control elements and/or one or more target anchor sequences), e.g., within a cell and not to non-targeted expression control regions (e.g., within the same cell).

The site-specific HNF4α disrupting agents of the invention comprise a site-specific HNF4α targeting moiety targeting an HNF4α expression control region. The expression control region targeted by the site-specific targeting moiety may be, for example, a transcriptional control element or an anchor sequence, such as an anchor sequence within an anchor-mediated conjunction.

Thus, site-specific HNF4α disrupting agents of the invention may modulate expression of a gene, i.e., HNF4α, e.g., by modulating expression of the gene from an endogenous promoter, an enhancer, or a repressor, may alter methylation of the control region, may alter at least one anchor sequence; may alter at least one conjunction nucleating molecule binding site, such as by altering binding affinity for the conjunction nucleating molecule; may alter an orientation of at least one common nucleotide sequence, such as a CTCF binding motif by, e.g., substitution, addition or deletion in at least one anchor sequence, such as a CTCF binding motif.

In certain embodiments, the site-specific disrupting agents and compositions described herein target an expression control region comprising one or more HNF4α-specific transcriptional control elements to modulate expression in a cell. HNF4α-specific transcriptional control elements that can be targeted include HNF4α-specific promoters, HNF4α-specific enhancers, and HNF4α-specific repressors. In one embodiment, an HNF4α-specific promoter substantially drives expression in cells of the liver, i.e., promoter 1. In one embodiment, an HNF4α-specific promoter substantially drives expression in cells of the pancreas, i.e., promoter 2. The nucleotide sequences of HNF4α promoter 1 and promoter 2 are known and may be found in, for example, GenBank Accession No. NC_000020.10 (42984441 . . . 43061485).

For example, a site-specific disrupting agent may include a site-specific targeting moiety, e.g., a nucleic acid molecule encoding a DNA-binding domain of a Transcription activator-like effector (TALE) polypeptide or a zinc finger (ZNF) polypeptide, or fragment thereof, that specifically targets and binds to an HNF4α expression control region, such as an HNF4α endogenous promoter region, e.g., promoter 1, and an effector molecule, such as an effector molecule that includes a transcriptional enhancer or transcriptional repressor that modulates, e.g., enhances or represses, expression of a target gene from an endogenous promoter to modulate gene expression. In one embodiment, the disrupting agent is "bicistronic nucleic acid molecule," i.e., capable of making two fusion proteins from a single messenger RNA molecule, a first and a second site-specific targeting moiety, e.g., a nucleic acid molecule encoding a DNA-binding domain of a Transcription activator-like effector (TALE) polypeptide or a zinc finger (ZNF) polypeptide, or fragment thereof, that specifically targets and binds to an HNF4α expression control region, such as an HNF4α endogenous promoter region, e.g., promoter 1, and an effector molecule, such as an effector molecule that includes a transcriptional enhancer or transcriptional repressor that modulates, e.g., enhances or represses, expression of a target gene from an endogenous promoter to modulate gene expression.

In some embodiments of the invention, a site-specific disrupting agent may include a site-specific targeting moiety, e.g., a nucleic acid molecule such as a guide RNA targeting an HNF4α endogenous promoter region, e.g., promoter 1, and an effector molecule, such as an effector molecule that includes a transcriptional enhancer or transcriptional repressor that modulates, e.g., enhances or represses, expression of a target gene from an endogenous promoter to modulate gene expression.

In certain embodiments of the invention, the site-specific disrupting agents and compositions described herein target an expression control region comprising one or more HNF4α-associated anchor sequences, e.g., within an anchor sequence-mediated conjunction, comprising a first and a second HNF4α-associated anchor sequence to alter a two-dimensional chromatin structure (e.g., anchor sequence-mediated conjunctions in order to modulate expression in a cell, e.g., a cell within a subject, e.g., by modifying anchor sequence-mediated conjunctions in DNA, e.g., genomic DNA.

In one aspect, the invention includes a site-specific HNF4α disrupting agent comprising a site-specific HNF4α targeting moiety which targets an HNF4α expression control region comprising one or more HNF4α-associated anchor sequences within an anchor sequence-mediated conjunction. The disrupting agent binds, e.g., specifically binds, a specific anchor sequence-mediated conjunction to alter a topology of the anchor sequence-mediated conjunction, e.g., an anchor sequence-mediated conjunction having a physical interaction of two or more DNA loci bound by a conjunction nucleating molecule.

The formation of an anchor sequence-mediated conjunction may force transcriptional control elements to interact with an HNF4α gene or spatially constrain the activity of the transcriptional control elements. Altering anchor sequence-mediated conjunctions, therefore, allows for modulating HNF4α expression without altering the coding sequences of the HNF4α gene being modulated.

In some embodiments, the site-specific disrupting agents and compositions of the invention modulate expression of anHNF4α gene associated with an anchor sequence-mediated conjunction by physically interfering between one or more anchor sequences and a conjunction nucleating molecule. For example, a DNA binding small molecule (e.g., minor or major groove binders), peptide (e.g., zinc finger, TALE, novel or modified peptide), protein (e.g., CTCF, modified CTCF with impaired CTCF binding and/or cohesion binding affinity), or nucleic acids (e.g., ssDNA, modified DNA or RNA, peptide oligonucleotide conjugates, locked nucleic acids, bridged nucleic acids, polyamides, and/or triplex forming oligonucleotides) may physically prevent a conjunction nucleating molecule from interacting with one or more anchor sequences to modulate HNF4α gene expression.

In some embodiments, the site-specific disrupting agents and compositions of the invention modulate expression of an HNF4α gene associated with an anchor sequence-mediated conjunction by modification of an anchor sequence, e.g., epigenetic modifications, e.g., histone protein modifications, or genomic editing modifications. For example, one or more anchor sequences associated with an anchor sequence-mediated conjunction comprising an HNF4α gene may be targeted for methylation modification by a DNA methyltransferase, e.g., dCas9-methyltransferase fusion, e.g., antisense oligonucleotide-enzyme fusion, to modulate expression of the gene.

In some embodiments, the site-specific disrupting agents and compositions of the invention modulate expression of an HNF4α gene associated with an anchor sequence-mediated conjunction, e.g., activate or represses transcription, e.g., induces epigenetic changes to chromatin.

In some embodiments, an anchor sequence-mediated conjunction includes one or more anchor sequences, an HNF4α gene, and one or more transcriptional control elements, such as an enhancing or silencing element. In some embodiments, the transcriptional control element is within, partially within, or outside the anchor sequence-mediated conjunction.

In one embodiment, the anchor sequence-mediated conjunction comprises a loop, such as an intra-chromosomal loop. In certain embodiments, the anchor sequence-mediated conjunction has a plurality of loops. One or more loops may include a first anchor sequence, a nucleic acid sequence, a transcriptional control element, and a second anchor sequence. In another embodiment, at least one loop includes, in order, a first anchor sequence, a transcriptional control element, and a second anchor sequence; or a first anchor sequence, a nucleic acid sequence, and a second anchor sequence. In yet another embodiment, either one or both of the nucleic acid sequences and the transcriptional control element is located within or outside the loop. In still another embodiment, one or more of the loops comprises a transcriptional control element.

In some embodiments, the anchor sequence-mediated conjunction includes a TATA box, a CAAT box, a GC box, or a CAP site.

In some embodiments, the anchor sequence-mediated conjunction comprises a plurality of loops, and where the anchor sequence-mediated conjunction comprises at least one of an anchor sequence, a nucleic acid sequence, and a transcriptional control element in one or more of the loops.

In one aspect, the site-specific disrupting agents and compositions of the invention may introduce a targeted alteration to an anchor sequence-mediated conjunction to modulate expression of a nucleic acid sequence with a disrupting agent that binds the anchor sequence. In some embodiments, the anchor sequence-mediated conjunction is altered by targeting one or more nucleotides within the anchor sequence-mediated conjunction for substitution, addition or deletion.

In some embodiments, expression, e.g., transcription, is activated by inclusion of an activating loop or exclusion of a repressive loop. In one such embodiment, the anchor sequence-mediated conjunction comprises a transcriptional control sequence that increases transcription of a nucleic acid sequence, e.g., such an HNF4α encoding nucleic acid. In another such embodiment, the anchor sequence-mediated conjunction excludes a transcriptional control element that decreases expression, e.g., transcription, of a nucleic acid sequence, e.g., such an HNF4α encoding nucleic acid.

In some embodiments, expression, e.g., transcription, is repressed by inclusion of a repressive loop or exclusion of an activating loop. In one such embodiment, the anchor sequence-mediated conjunction includes a transcriptional control element that decreases expression, e.g., transcription, of a nucleic acid sequence, e.g., such an HNF4α encoding nucleic acid sequence. In another such embodiment, the anchor sequence-mediated conjunction excludes a transcriptional control sequence that increases transcription of a nucleic acid sequence, e.g., such an HNF4α encoding nucleic acid.

Each anchor sequence-mediated conjunction comprises one or more anchor sequences, e.g., a plurality. Anchor sequences can be manipulated or altered to disrupt naturally occurring loops or form new loops (e.g., to form exogenous loops or to form non-naturally occurring loops with exogenous or altered anchor sequences). Such alterations modulate HNF4α gene expression by changing the 2-dimensional structure of DNA containing all or a portion of an HNF4α gene, e.g., by thereby modulating the ability of the HNF4α gene to interact with transcriptional control elements (e.g., enhancing and silencing/repressive sequences). In some embodiments, the chromatin structure is modified by substituting, adding or deleting one or more nucleotides within an anchor sequence of the anchor sequence-mediated conjunction.

The anchor sequences may be non-contiguous with one another. In embodiments with noncontiguous anchor sequences, the first anchor sequence may be separated from the second anchor sequence by about 500 bp to about 500 Mb, about 750 bp to about 200 Mb, about 1 kb to about 100 Mb, about 25 kb to about 50 Mb, about 50 kb to about 1 Mb, about 100 kb to about 750 kb, about 150 kb to about 500 kb, or about 175 kb to about 500 kb. In some embodiments, the first anchor sequence is separated from the second anchor sequence by about 500 bp, 600 bp, 700 bp, 800 bp, 900 bp, 1 kb, 5 kb, 10 kb, 15 kb, 20 kb, 25 kb, 30 kb, 35 kb, 40 kb, 45 kb, 50 kb, 55 kb, 60 kb, 65 kb, 70 kb, 75 kb, 80 kb, 85 kb, 90 kb, 95 kb, 100 kb, 125 kb, 150 kb, 175 kb, 200 kb, 225 kb, 250 kb, 275 kb, 300 kb, 350 kb, 400 kb, 500 kb, 600 kb, 700 kb, 800 kb, 900 kb, 1 Mb, 2 Mb, 3 Mb, 4 Mb, 5 Mb, 6 Mb, 7 Mb, 8 Mb, 9 Mb, 10 Mb, 15 Mb, 20 Mb, 25 Mb, 50 Mb, 75 Mb, 100 Mb, 200 Mb, 300 Mb, 400 Mb, 500 Mb, or any size therebetween.

In one embodiment, the anchor sequence comprises a common nucleotide sequence, e.g., a CTCF-binding motif:

(SEQ ID NO: 64)
N(T/C/G)N(G/A/T)CC(A/T/G)(C/G)(C/T/A)AG(G/A)(G/T)

GG(C/A/T)(G/A)(C/G)(C/T/A)(G/A/C), where N is any nucleotide.

A CTCF-binding motif may also be in the opposite orientation, e.g., (SEQ ID NO: 65)
(G/A/C)(C/T/A)(C/G)(G/A)(C/A/T)GG(G/T)(G/A)GA (C/T/A)(C/G)(A/T/G)CC(G/A/T)N(T/C/G)N.

In one embodiment, the anchor sequence comprises SEQ ID NO: 64 or SEQ ID NO:65 or a nucleotide sequence at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99% identical to either SEQ ID NO: 64 or SEQ ID NO:65.

In some embodiments, the anchor sequence-mediated conjunction comprises at least a first anchor sequence and a second anchor sequence. The first anchor sequence and second anchor sequence may each comprise a common nucleotide sequence, e.g., each comprises a CTCF binding motif. In some embodiments, the first anchor sequence and second anchor sequence comprise different sequences, e.g., the first anchor sequence comprises a CTCF binding motif and the second anchor sequence comprises an anchor sequence other than a CTCF binding motif. In some embodiments, each anchor sequence comprises a common nucleotide sequence and one or more flanking nucleotides on one or both sides of the common nucleotide sequence.

Two CTCF-binding motifs (e.g., contiguous or non-contiguous CTCF binding motifs) that can form a conjunction may be present in the genome in any orientation, e.g., in the same orientation (tandem) either 5'→3' (left tandem, e.g., the two CTCF-binding motifs that comprise SEQ ID NO: 64) or 3'→5' (right tandem, e.g., the two CTCF-binding motifs comprise SEQ ID NO: 65), or convergent orientation, where one CTCF-binding motif comprises SEQ ID NO: 64 and the other comprises SEQ ID NO: 65. CTCFBSDB 2.0: Database For CTCF binding motifs And Genome Organization can be used to identify CTCF binding motifs associated with a target gene, e.g., HNF4α.

In some embodiments, the anchor sequence-mediated conjunction is altered by changing an orientation of at least one common nucleotide sequence, e.g., a conjunction nucleating molecule binding site.

In some embodiments, the anchor sequence comprises a conjunction nucleating molecule binding site, e.g., CTCF binding motif, and site-specific disrupting agent of the invention introduces an alteration in at least one conjunction nucleating molecule binding site, e.g. altering binding affinity for the conjunction nucleating molecule.

In some embodiments, the anchor sequence-mediated conjunction is altered by introducing an exogenous anchor sequence. Addition of a non-naturally occurring or exogenous anchor sequence to form or disrupt a naturally occurring anchor sequence-mediated conjunction, e.g., by inducing a non-naturally occurring loop to form that alters transcription of the nucleic acid sequence.

In some embodiments, the anchor sequence-mediated conjunction comprises an HNF4α gene, and one or more, e.g., 2, 3, 4, 5, or other genes other than the HNF4α gene.

In some embodiments, the anchor sequence-mediated conjunction is associated with one or more, e.g., 2, 3, 4, 5, or more, transcriptional control elements. In some embodiments, the HNF4α gene is noncontiguous with one or more of the transcriptional control elements. In some embodiments where the HNF4α gene is non-contiguous with the transcriptional control element, the gene may be separated from one or more transcriptional control elements by about 100 bp to about 500 Mb, about 500 bp to about 200 Mb, about 1 kb to about 100 Mb, about 25 kb to about 50 Mb, about 50 kb to about 1 Mb, about 100 kb to about 750 kb, about 150 kb to about 500 kb, or about 175 kb to about 500 kb. In some embodiments, the gene is separated from the transcriptional control element by about 100 bp, 300 bp, 500 bp, 600 bp, 700 bp, 800 bp, 900 bp, 1 kb, 5 kb, 10 kb, 15 kb, 20 kb, 25 kb, 30 kb, 35 kb, 40 kb, 45 kb, 50 kb, 55 kb, 60 kb, 65 kb, 70 kb, 75 kb, 80 kb, 85 kb, 90 kb, 95 kb, 100 kb, 125 kb, 150 kb, 175 kb, 200 kb, 225 kb, 250 kb, 275 kb, 300 kb, 350 kb, 400 kb, 500 kb, 600 kb, 700 kb, 800 kb, 900 kb, 1 Mb, 2 Mb, 3 Mb, 4 Mb, 5 Mb, 6 Mb, 7 Mb, 8 Mb, 9 Mb, 10 Mb, 15 Mb, 20 Mb, 25 Mb, 50 Mb, 75 Mb, 100 Mb, 200 Mb, 300 Mb, 400 Mb, 500 Mb, or any size therebetween.

In some embodiments, the type of anchor sequence-mediated conjunction may help to determine how to modulate gene expression, e.g., choice of site-specific targeting moiety, by altering the anchor sequence-mediated conjunction. For example, some types of anchor sequence-mediated conjunctions comprise one or more transcription control elements within the anchor sequence-mediated conjunction. Disruption of such an anchor sequence-mediated conjunction by disrupting the formation of the anchor sequence-mediated conjunction, e.g., altering one or more anchor sequences, is likely to decrease transcription of an HNF4α gene within the anchor sequence-mediated conjunction.

In some embodiments, expression of the HNF4α gene is regulated, modulated, or influenced by one or more transcriptional control elements associated with the anchor sequence-mediated conjunction. In some embodiments, the anchor sequence-mediated conjunction comprises an HNF4α gene and one or more transcriptional control elements. For example, the HNF4α gene and one or more transcriptional control sequences are located within, at least partially, an anchor sequence-mediated conjunction, e.g., a Type 1 anchor sequence-mediated conjunction. The anchor sequence-mediated conjunction may also be referred to as a "Type 1, EP subtype." In some embodiments, the HNF4α gene has a defined state of expression, e.g., in its native state, e.g., in a diseased state. For example, the HNF4α gene may have a high level of expression. By disrupting the anchor sequence-mediated conjunction, expression of the HNF4α gene may be decreased, e.g., decreased transcription due to conformational changes of the DNA previously open to transcription within the anchor sequence-mediated conjunction, e.g., decreased transcription due to conformational changes of the DNA creating additional distance between the HNF4α gene and the enhancing sequences. In one embodiment, both the HNF4α gene associated and one or more transcriptional control sequences, e.g., enhancing sequences, reside inside the anchor sequence-mediated conjunction. Disruption of the anchor sequence-mediated conjunction decreases expression of the HNF4α gene. In one embodiment, the HNF4α gene associated with the anchor sequence-mediated conjunction is accessible to one or more transcriptional control elements that reside inside, at least partially, the anchor sequence-mediated conjunction.

In some embodiments, expression of the HNF4α gene is regulated, modulated, or influenced by one or more transcriptional control elements associated with, but inaccessible due to the anchor sequence-mediated conjunction. For example, the anchor sequence-mediated conjunction associated with an HNF4α gene disrupts the ability of one or more transcriptional control elements to regulate, modulate, or influence expression of the HNF4α gene. The transcriptional control sequences may be separated from the HNF4α gene, e.g., reside on the opposite side, at least partially, e.g., inside or outside, of the anchor sequence-mediated conjunction as the HNF4α gene, e.g., the HNF4α gene is inaccessible to the transcriptional control elements due to proximity of the anchor sequence-mediated conjunction. In some embodiments, one or more enhancing sequences are separated from the HNF4α gene by the anchor sequence-mediated conjunction, e.g., a Type 2 anchor sequence-mediated conjunction.

In some embodiments, the HNF4α gene is inaccessible to one or more transcriptional control elements due to the anchor sequence-mediated conjunction, and disruption of the anchor sequence-mediated conjunction allows the transcriptional control element to regulate, modulate, or influence expression of the HNF4α gene. In one embodiment, the HNF4α gene is inside and outside the anchor sequence-mediated conjunction and inaccessible to the one or more transcriptional control elements. Disruption of the anchor sequence-mediated conjunction increases access of the transcriptional control elements to regulate, modulate, or influence expression of the HNF4α gene, e.g., the transcriptional control elements increase expression of the HNF4α gene. In one embodiment, the HNF4α gene is inside the anchor sequence-mediated conjunction and inaccessible to the one or more transcriptional control elements residing outside, at least partially, the anchor sequence-mediated conjunction. Disruption of the anchor sequence-mediated conjunction increases expression of the HNF4α gene. In one embodiment, the HNF4α gene is outside, at least partially, the anchor sequence-mediated conjunction and inaccessible to the one or more transcriptional control elements residing inside the anchor sequence-mediated conjunction. Disruption of the anchor sequence-mediated conjunction increases expression of the HNF4α gene.

A. HNF4α Site-Specific Targeting Moieties

The site-specific HNF4α targeting moieties of the invention target an HNF4α expression control region and may comprise a polymer or polymeric molecule, such as a polyimide (i.e., a molecule of repeating units linked by amide binds, e.g., a polypeptide), a polymer of nucleotides (such as a guide RNA, a nucleic acid molecule encoding a TALE polypeptide or a zinc finger polypeptides), a peptide nucleic acid (PNA), or a polymer of amino acids, such as a peptide or polypeptide, e.g., a fusion protein, etc. Suitable site-specific HNF4α targeting moieties, compositions, and methods of use of such agents and compositions are described below and in PCT Publication WO 2018/049073, the entire contents of which are expressly incorporated herein by reference.

In one embodiment, a site specific disrupting agent of the invention comprises a site-specific HNF4α targeting moiety comprising a nucleic acid molecule encoding a polypeptide, such as a DNA-binding domain, of a Transcription activator-like effector (TALE) polypeptide or a zinc finger (ZNF) polypeptide, or fragment thereof, that is engineered to specifically target an HNF4α expression control region to modulate expression of an HNF4α gene.

In another embodiment, a site-specific disrupting agent of the invention comprises a site-specific HNF4α targeting moiety comprising a nucleic acid molecule, such as a guide RNA (or gRNA) or a guide RNA and an effector, or fragment thereof, or nucleic acid molecule encoding an effector, or fragment thereof.

In another embodiment, a site-specific disrupting agent of the invention comprises a site-specific HNF4α targeting moiety comprising a polynucleotide, such as a PNA, e.g., a nucleic acid gRNA linked to an effector polypeptide, or fragment thereof.

In another embodiment, a site-specific disrupting agent of the invention comprises a site-specific HNF4α targeting moiety comprising a fusion molecule, such as a nucleic acid molecule encoding a DNA-binding domain, of a Transcription activator-like effector (TALE) polypeptide or a zinc finger (ZNF) polypeptide, or fragment thereof, and an effector.

In one embodiment, such site-specific disrupting agents comprise a second fusion protein, wherein the second fusion protein comprises a second site-specific HNF4α targeting moiety which targets a second HNF4α expression control region and a second effector molecule, wherein the second HNF4α expression control region is different than the HNF4α expression control region.

In another embodiment, a site-specific disrupting agent of the invention comprises a site-specific HNF4α targeting moiety comprising a fusion molecule, such as a nucleic acid molecule encoding a protein comprising a Cas polypeptide and, e.g., an epigenetic recruiter or an epigenetic CpG modifier.

In yet, another embodiment, a site-specific disrupting agent of the invention comprises a site-specific HNF4α targeting moiety comprising a fusion molecule, such as fusion protein comprising a Cas polypeptide and, e.g., an epigenetic recruiter or an epigenetic CpG modifier.

As used herein, in its broadest sense, the term "nucleic acid" refers to any compound and/or substance that is or can be incorporated into an oligonucleotide chain. In some embodiments, a nucleic acid is a compound and/or substance that is or can be incorporated into a polynucleotide chain via a phosphodiester linkage. As will be clear from context, in some embodiments, "nucleic acid" refers to an individual nucleic acid residue (e.g., a nucleotide and/or nucleoside); in some embodiments, "nucleic acid" refers to a polynucleotide chain comprising individual nucleic acid residues. In some embodiments, a "nucleic acid" is or comprises RNA; in some embodiments, a "nucleic acid" is or comprises DNA. In some embodiments, a "nucleic acid" is a "mixmer" comprising locked nucleic acid molecules and deoxynucleic acid molecules. In some embodiments, a nucleic acid is, comprises, or consists of one or more natural nucleic acid residues. In some embodiments, a nucleic acid is, comprises, or consists of one or more nucleic acid analogs. In some embodiments, a nucleic acid analog differs from a nucleic acid in that it does not utilize a phosphodiester backbone. For example, in some embodiments, a nucleic acid is, comprises, or consists of one or more "peptide nucleic acids", which are known in the art and have peptide bonds instead of phosphodiester bonds in the backbone, are considered within the scope of the present invention. Alternatively or additionally, in some embodiments, a nucleic acid has one or more phosphorothioate and/or 5'-N-phosphoramidite linkages rather than phosphodiester bonds. In some embodiments, a nucleic acid is, comprises, or consists of one or more natural nucleosides (e.g., adenosine, thymidine, guanosine, cytidine, uridine, deoxyadenosine, deoxythymidine, deoxy guanosine, and deoxycytidine). In some embodiments, a nucleic acid is, comprises, or consists of one or more nucleoside analogs (e.g., 2-aminoadenosine, 2-thiothymidine, inosine, pyrrolo-pyrimidine, 3-methyl adenosine, 5-methylcytidine, C-5 propynyl-cytidine, C-5 propynyl-uridine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, 0(6)-methylguanine, 2-thiocytidine, methylated bases, intercalated bases, and combinations thereof). In some embodiments, a nucleic acid comprises one or more modified sugars (e.g., 2'-fluororibose, ribose, 2'-deoxyribose, arabinose, and hexose) as compared with those in natural nucleic acids. In some embodiments, a nucleic acid has a nucleotide sequence that encodes a functional gene product such as an RNA or protein. In some embodiments, a nucleic acid includes one or more introns. In some embodiments, nucleic acids are prepared by one or more of isolation from a natural source, enzymatic synthesis by polymerization based on a complementary template (in vivo or in vitro), reproduction in a recombinant cell or system, and chemical synthesis. In some embodiments, a nucleic acid is at least 3, 4, 5, 6, 7, 8, 9, 10, 15, 20, 25, 30, 35, 40, 45, 50, 55, 60, 65, 70, 75, 80, 85, 90, 95, 100, 110, 120, 130, 140, 150, 160, 170, 180, 190, 20, 225, 250, 275, 300, 325, 350, 375, 400, 425, 450, 475, 500, 600, 700, 800, 900, 1000, 1500, 2000, 2500, 3000, 3500, 4000, 4500, 5000 or more residues long. In some embodiments, a nucleic acid is partly or wholly single stranded; in some embodiments, a nucleic acid is partly or wholly double stranded. In some embodiments a nucleic acid has a nucleotide sequence comprising at least one element that encodes, or is the complement of a sequence that encodes, a polypeptide. In some embodiments, a nucleic acid has enzymatic activity.

As used herein, the terms "peptide," "polypeptide," and "protein" refer to a compound comprised of amino acid residues covalently linked by peptide bonds, or by means other than peptide bonds. A protein or peptide must contain at least two amino acids, and no limitation is placed on the maximum number of amino acids that can comprise a protein's or peptide's sequence. Polypeptides include any peptide or protein comprising two or more amino acids joined to each other by peptide bonds or by means other than peptide bonds. As used herein, the term refers to both short chains, which also commonly are referred to in the art as peptides, oligopeptides and oligomers, for example, and to longer chains, which generally are referred to in the art as proteins, of which there are many types.

In certain embodiments, a polypeptide is or may comprise a chimeric or "fusion protein." As used herein, a "chimeric protein" or "fusion protein" comprises all or part (preferably a biologically active part) of a first protein operably linked to a heterologous second polypeptide (i.e., a polypeptide other than the first protein). Within the fusion protein, the term "operably linked" is intended to indicate that the first protein or segment thereof and the heterologous polypeptide are fused in-frame to each other. The heterologous polypeptide can be fused to the amino-terminus or the carboxyl-terminus of the first protein or segment.

A "polyamide" is a polymeric molecule with repeating units linked by amide binds. Proteins are examples of naturally occurring polyamides. In some embodiments, a polyamide comprises a peptide nucleic acid (PNA).

A "peptide nucleic acid" ("PNA") is a molecule in which one or more amino acid units in the PNA have an amide containing backbone, e.g., aminoethyl-glycine, similar to a peptide backbone, with a nucleic acid side chain in place of the amino acid side chain. Peptide nucleic acids (PNA) are known to hybridize complementary DNA and RNA with higher affinity than their oligonucleotide counterparts. This character of PNA not only makes them a stable hybrid with the nucleic acid side chains, but at the same time, the neutral backbone and hydrophobic side chains result in a hydrophobic unit within the polypeptide. The nucleic acid side chain includes, but is not limited to, a purine or a pyrimidine side chain such as adenine, cytosine, guanine, thymine and uracil. In one embodiment, the nucleic acid side chain includes a nucleoside analog as described herein.

In one embodiment, a site-specific HNF4α targeting moiety of the invention comprises a polyamide. Suitable polyamides for use in the agents and compositions of the invention are known in the art.

In one embodiment, a site-specific HNF4α targeting moiety of the invention comprises a polynucleotide. In some embodiments, the nucleotide sequence of the polynucleotide encodes an HNF4α gene or an HNF4α expression product. In some embodiments, the nucleotide sequence of the polynucleotide does not include an HNF4α coding sequence or an HNF4α expression product. For example, in some embodiments, a site-specific HNF4α targeting moiety of the invention comprises a polynucleotide that hybridizes to a target expression control region, e.g., a promoter or an anchor sequence. In some embodiments, the nucleotide sequence of the polynucleotide is a complement of a target anchor sequence, or has a sequence that is at least 80%, at least 85%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99% identical to a complement of the target sequence.

The polynucleotides of the invention may include deoxynucleotides, ribonucleotides, modified deoxynucleotides, modified ribonucleotides (e.g., chemical modifications, such as modifications that alter the backbone linkages, sugar molecules, and/or nucleic acid bases), and artificial nucleic acids. In some embodiments, the polynucleotide includes, but is not limited to, genomic DNA, cDNA, peptide nucleic acids (PNA) or peptide oligonucleotide conjugates, locked nucleic acids (LNA), bridged nucleic acids (BNA), polyamides, triplex forming oligonucleotides, modified DNA, antisense DNA oligonucleotides, tRNA, mPvNA, rPvNA, modified RNA, miRNA, gRNA, and siRNA or other RNA or DNA molecules.

In some embodiments, the polynucleotides of the invention have a length from about 2 to about 5000 nts, about 10 to about 100 nts, about 50 to about 150 nts, about 100 to about 200 nts, about 150 to about 250 nts, about 200 to about 300 nts, about 250 to about 350 nts, about 300 to about 500 nts, about 10 to about 1000 nts, about 50 to about 1000 nts, about 100 to about 1000 nts, about 1000 to about 2000 nts, about 2000 to about 3000 nts, about 3000 to about 4000 nts, about 4000 to about 5000 nts, or any range therebetween.

The polynucleotides of the invention may include nucleosides, e.g., purines or pyrimidines, e.g., adenine, cytosine, guanine, thymine and uracil. In some embodiments, the polynucleotides includes one or more nucleoside analogs. The nucleoside analog includes, but is not limited to, a nucleoside analog, such as 5-fluorouracil; 5-bromouracil, 5-chlorouracil, 5-iodouracil, hypoxanthine, xanthine, 4-acetylcytosine, 4-methylbenzimidazole, 5-(carboxyhydroxylmethyl) uracil, 5-carboxymethylaminomethyl-2-thiouridine, 5-carboxymethylaminomethyluracil, dihydrouracil, dihydrouridine, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3)w, 2,6-diaminopurine, 3-nitropyrrole, inosine, thiouridine, queuosine, wyosine, diaminopurine, isoguanine, isocytosine, diaminopyrimidine, 2,4-difluorotoluene, isoquinoline, pyrrolo[2,3-]pyridine, and any others that can base pair with a purine or a pyrimidine side chain.

In some embodiments, the site-specific HNF4α targeting moieties of the invention comprise a polynucleotide encoding a polypeptide that comprises a DNA-binding domain (DBD), or fragment thereof, of a zinc finger or TALE, that is engineered to specifically target an HNF4α expression control region to modulate expression of an HNF4α gene.

The design and preparation of such zinc finger polypeptides which specifically bind to a DNA target region of interest, such as an HNF4α expression control region, is well known in the art. For example, zinc finger (ZNF) proteins contain a DNA binding domain that specifically binds a triplet of nucleotides. Thus, to design and prepare the site-specific HNF4α targeting moieties of the invention, a modular assembly process which includes combining separate zinc finger DNA binding domains that can each recognize a specific 3-basepair DNA sequence to generate 3-finger, 4-, 5-, 6-, 7-, or 8-zinc finger polypeptide that recognizes specific target sites ranging from 9 base pairs to 24 base pairs in length may be used. Another suitable method may include 2-finger modules to generate ZNF polynucleotides with up to six individual zinc fingers. See, e.g., Shukla V K, et al., *Nature.* 459 (7245) 2009: 437-41; Dreier B, et al., MC. 280 (42) 2005: 35588-97; Dreier B, et al, *JBC* 276 (31) 2001: 29466-78; Bae K H, et al., *Nature Biotechnology.* 21 (3) 2003: 275-80.

In some embodiments, a site-specific HNF4α targeting moiety of the invention comprises a polynucleotide encoding a polypeptide that comprises a DNA-binding domain (DBD), or fragment thereof, of a zinc finger, that is engineered to specifically target an HNF4α expression control region to modulate expression of an HNF4α gene. Exemplary amino acid sequences encoding a zinc finger that binds to a nucleotide triplet suitable for use in the present invention are provide in Table 1A below. (See, e.g., Gersbach et al., Synthetic Zinc Finger Proteins: The Advent of Targeted Gene Regulation and Genome Modification Technologies).

TABLE 1A

| Amino Acid Sequence of Zing Finger DNA Binding Domain (Finger) | Nucleotide Triplet | SEQ ID NO. |
| --- | --- | --- |
| RKDALRG | TTG | 1 |
| TTGALTE | CTT | 2 |
| QRHHLVE | CTC | 3 |
| QNSTLTE | CTA | 4 |
| RNDALTE | CTG | 5 |
| HKNALQN | ATT | 6 |
| RRSACRR | ATC | 7 |
| QKSSLIA | ATA | 8 |
| RRDELNV | ATG | 9 |
| TSGSLVR | GTT | 10 |
| DPGALVR | GTC | 11 |
| QSSSLVR | GTA | 12 |
| RSDELVR | GTG | 13 |
| RLRDIQF | TCT | 14 |
| RSDERKR | TCC | 15 |
| RSDHLTT | TCA | 16 |
| RLRALDR | TCG | 17 |
| TKNSLTE | CCT | 18 |
| SKKHLAE | CCC | 19 |
| TSHSLTE | CCA | 20 |
| RNDTLTE | CCG | 21 |
| THLDLIR | ACT | 22 |
| DKKDLTR | ACC | 23 |
| SPADLTR | ACA | 24 |
| RTDTLRD | ACG | 25 |
| TSGELVR | GCT | 26 |
| DCRDLAR | GCC | 27 |
| QSGDLRR | GCA | 28 |
| RSDDLVR | GCG | 29 |
| ARGNLRT | TAT | 30 |
| SRGNLKS | TAC | 31 |
| QASNLIS | TAA | 32 |
| REDNLHT | TAG | 33 |

TABLE 1A-continued

| Amino Acid Sequence of Zing Finger DNA Binding Domain (Finger) | Nucleotide Triplet | SEQ ID NO. |
| --- | --- | --- |
| TSGNLTE | CAT | 34 |
| SKKALTE | CAC | 35 |
| QSGNLTE | CAA | 36 |
| RADNLTE | CAG | 37 |
| TTGNLTV | AAT | 38 |
| DSGNLRV | AAC | 39 |
| QRANLRA | AAA | 40 |
| RKDNLKN | AAG | 41 |
| TSGNLVR | GAT | 42 |
| DPGNLVR | GAC | 43 |
| QSSNLVR | GAA | 44 |
| RSDNLVR | GAG | 45 |
| APKALGW | TGC | 46 |
| QAGHLAS | TGA | 47 |
| RSDHLTT | TGG | 48 |
| SRRTCRA | CGT | 49 |
| HTGHLLE | CGC | 50 |
| QSGHLTE | CGA | 51 |
| RSDKLTE | CGG | 52 |
| HRTTLTN | AGT | 53 |
| ERSHLRE | AGC | 54 |
| QLAHLRA | AGA | 55 |
| RSDHLTN | AGG | 56 |
| TSGHLVR | GGT | 57 |
| DPGHLVR | GGC | 58 |
| QRAHLER | GGA | 59 |
| RSDKLVR | GGG | 60 |

A zinc finger DNA binding domain comprises an N-terminal region and a C-terminal region with the "fingers" that bind to the target DNA sequence in between. The N-terminal region generally is 7 amino acids in length. The C-terminal region is generally 6 amino acids in length. Thus, the N-terminal region generally comprises the amino acid sequence of $X_1X_2X_3X_4X_5X_6X_7$. "X" can be any amino acid. In some embodiments, the N-terminal region comprises the exemplary amino acid sequence of LEPGEKP (SEQ ID NO: 309). "X" can be any amino acid. The C-terminal region generally comprises the amino acid sequence of $X_{25}X_{26}X_{27}X_{28}X_{29}X_{30}$. In certain embodiments, the C-terminal region comprises the exemplary amino acid sequence of TGKKTS (SEQ ID NO: 310)

Each finger in the DNA binding domain is flanked by a N-terminal backbone located to the N-terminus of the finger and a C-terminal backbone located to the C-terminus of the finger. The N-terminal backbone of the finger generally is 11 amino acids long with two conservative cysteines (C) locate at $3^{rd}$ and $6^{th}$ positions. Thus, the N-terminal backbone of the finger generally comprises the amino acid sequence of $X_8X_9CX_{10}X_{11}CX_{12}X_{13}X_{14}X_{15}X_{16}$. "X" can be any amino acid. The C-terminal backbone of the finger generally is 5 amino acids long with two conservative histines (H) located at $1^{st}$ and $5^{th}$ positions. Thus, the C-terminal backbone of the finger generally comprises the amino acid sequence of $HX_{17}X_{18}X_{19}H$. "X" can be any amino acid. In some embodiments, the N-terminal backbone comprises the exemplary amino acid sequence of YKCPECGKSFS (SEQ ID No. 61) and the C-terminal backbone comprises the exemplary amino acid sequence of HQRTH (SEQ ID No. 62). Two "fingers" are linked through a linker. A linker generally is 5 amino acids in length and comprises the amino acid sequence of $X_{20}X_{21}X_{22}X_{23}X_{24}$. "X" can be any amino acid. In certain embodiments, the linker comprises the exemplary amino acid sequence of TGEKP (SEQ ID No. 63). Thus, the zinc finger of a site specific HNF4α site-specific disrupting agent has a structure as follows: (N-terminal backbone-finger-C-terminal backbone-linker)$_n$ and the zinc finger DNA binding domain of a site specific HNF4α site-specific disrupting agent has a structure as follows: [INT-terminal region (N-terminal backbone-finger-C-terminal backbone-linker)$_n$-C-terminal region]. "N" represents the number of triplets of nucleotides to which the zinc finger DNA binding domain and, thus, to which the HNF4α site-specific disrupting agent binds.

The "finger" amino acid sequences of four nucleotide triplets are unknown, however, if such a triplet is identified in a target area of interest, two "linker span sequences"—linker span 1 and linker span 2—are useful to circumvent the issue. Linker span 1 is used to skip one base pair if a "finger" amino acid sequence of a triplet is not available. Linker span 2 is used to skip 2 base pairs if a "finger" amino acid sequence of a triplet is not available. Linker span 1 is generally 12 amino acids long. Linker span 2 is generally 16 amino acids long. Thus, linker span 1 generally comprises the amino acid sequence of $X_{31}X_{32}X_{33}X_{34}X_{35}X_{36}X_{37}X_{38}X_{39}X_{40}X_{41}X_{42}$. Linker span 2 generally comprises the amino acid sequence of $X_{43}X_{44}X_{45}X_{46}X_{47}X_{48}X_{49}X_{50}X_{51}X_{52}X_{53}X_{54}X_{55}X_{56}X_{57}X_{58}$. In some embodiments, linker span 1 comprises the amino acid sequence of THPRAPIPKPFQ (SEQ ID NO: 311). In certain embodiments, linker span 2 comprises the amino acid sequence of TPNPHRRTDPSHKPFQ (SEQ ID NO: 312). When linker span 1 and/or linker span 2 is used, the finger-linker span 1/span 2-finger comprises the structure as follows: N-terminal back bone-finger-C-terminal backbone-linker span 1/span 2-N-terminal backbone-finger-C-terminal backbone-linker.

Table 1B provides the amino acid sequence structure of exemplary zinc finger DNA binding domains of the disrupting agents comprising a zinc finger DNA binding domain described in the working examples below (see Table 6A). Table 10 also provides the nucleotide sequence of suitable target sequences in the expression control region, the amino acid sequences of exemplary zinc finger DNA binding domains suitable for use in the disrupting agents comprising a zinc finger DNA binding domain of the present invention as well as the amino acid sequence structure of the exemplary zinc finger DNA binding domains suitable for use in the disrupting agents comprising a zinc finger DNA binding domain of the present invention. The "X," as used in Table 1B, represents any amino acid.

In some embodiments, a zinc finger DNA binding domain suitable for use in the disrupting agents of the invention comprises an amino acid sequence having at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99% amino acid identity to the entire amino acid sequence of any one of the zinc finger DNA binding domains provided in any one of Tables 6A and 10.

TABLE 1B

| Name of Exemplary Zinc Finger DNA Binding Domain | Amino Acid Sequence Structure | SEQ ID NO: |
|---|---|---|
| ZF1 | $X_1X_2X_3X_4X_5X_6X_7X_8X_9CX_{10}X_{11}CX_{12}X_{13}X_{14}X_{15}X_{16}$RSDNLVRH$X_{17}X_{18}$ $X_{19}HX_{20}X_{21}X_{22}X_{23}X_{24}X_8X_9CX_{10}X_{11}CX_{12}X_{13}X_{14}X_{15}X_{16}$RSDHLTNH$X_{17}$ $X_{18}X_{19}HX_{20}X_{21}X_{22}X_{23}X_{24}X_8X_9CX_{10}X_{11}CX_{12}X_{13}X_{14}X_{15}X_{16}$DPGHLVR H$X_{17}X_{18}X_{19}HX_{20}X_{21}X_{22}X_{23}X_{24}X_8X_9CX_{10}X_{11}CX_{12}X_{13}X_{14}X_{15}X_{16}$QRAH LERH$X_{17}X_{18}X_{19}HX_{20}X_{21}X_{22}X_{23}X_{24}X_8X_9CX_{10}X_{11}CX_{12}X_{13}X_{14}X_{15}X_{16}$SR RTCRAH$X_{17}X_{18}X_{19}HX_{20}X_{21}X_{22}X_{23}X_{24}X_8X_9CX_{10}X_{11}CX_{12}X_{13}X_{14}X_{15}X_{16}$ RSDKLTEH$X_{17}X_{18}X_{19}HX_{20}X_{21}X_{22}X_{23}X_{24}X_8X_9CX_{10}X_{11}CX_{12}X_{13}X_{14}X_{15}$ $X_{16}$RNDTLTEH$X_{17}X_{18}X_{19}HX_{20}X_{21}X_{22}X_{23}X_{24}X_{25}X_{26}X_{27}X_{28}X_{29}X_{30}$ | 313 |
| ZF2 | $X_1X_2X_3X_4X_5X_6X_7X_8X_9CX_{10}X_{11}CX_{12}X_{13}X_{14}X_{15}X_{16}$QSSNLVRH$X_{17}X_{18}$ $X_{19}HX_{20}X_{21}X_{22}X_{23}X_{24}X_8X_9CX_{10}X_{11}CX_{12}X_{13}X_{14}X_{15}X_{16}$SKKHLAEH$X_{17}$ $X_{18}X_{19}HX_{20}X_{21}X_{22}X_{23}X_{24}X_8X_9CX_{10}X_{11}CX_{12}X_{13}X_{14}X_{15}X_{16}$SKKALTEH $X_{17}X_{18}X_{19}HX_{20}X_{21}X_{22}X_{23}X_{24}X_8X_9CX_{10}X_{11}CX_{12}X_{13}X_{14}X_{15}X_{16}$DCRDL ARH$X_{17}X_{18}X_{19}HX_{20}X_{21}X_{22}X_{23}X_{24}X_8X_9CX_{10}X_{11}CX_{12}X_{13}X_{14}X_{15}X_{16}$DP GHLVRH$X_{17}X_{18}X_{19}HX_{20}X_{21}X_{22}X_{23}X_{24}X_8X_9CX_{10}X_{11}CX_{12}X_{13}X_{14}X_{15}X_{16}$ RNDALTEH$X_{17}X_{18}X_{19}HX_{20}X_{21}X_{22}X_{23}X_{24}X_8X_9CX_{10}X_{11}CX_{12}X_{13}X_{14}X_{15}$ $X_{16}$DKKDLTRH$X_{17}X_{18}X_{19}HX_{20}X_{21}X_{22}X_{23}X_{24}X_{25}X_{26}X_{27}X_{28}X_{29}X_{30}$ | 314 |
| ZF3 | $X_1X_2X_3X_4X_5X_6X_7X_8X_9CX_{10}X_{11}CX_{12}X_{13}X_{14}X_{15}X_{16}$RSDNLVRH$X_{17}X_{18}$ $X_{19}HX_{20}X_{21}X_{22}X_{23}X_{24}X_8X_9CX_{10}X_{11}CX_{12}X_{13}X_{14}X_{15}X_{16}$QLAHLRAH$X_{17}$ $X_{18}X_{19}HX_{20}X_{21}X_{22}X_{23}X_{24}X_8X_9CX_{10}X_{11}CX_{12}X_{13}X_{14}X_{15}X_{16}$DPGHLVR H$X_{17}X_{18}X_{19}HX_{20}X_{21}X_{22}X_{23}X_{24}X_8X_9CX_{10}X_{11}CX_{12}X_{13}X_{14}X_{15}X_{16}$QSSNL VRH$X_{17}X_{18}X_{19}HX_{20}X_{21}X_{22}X_{23}X_{24}X_8X_9CX_{10}X_{11}CX_{12}X_{13}X_{14}X_{15}X_{16}$RK DNLKNH$X_{17}X_{18}X_{19}HX_{20}X_{21}X_{22}X_{23}X_{24}X_8X_9CX_{10}X_{11}CX_{12}X_{13}X_{14}X_{15}X61$ QAGHLASH$X_{17}X_{18}X_{19}HX_{20}X_{21}X_{22}X_{23}X_{24}X_8X_9CX_{10}X_{11}CX_{12}X_{13}X_{14}X_{15}$ $X_{16}$TSGSLVRH$X_{17}X_{18}X_{19}HX_{20}X_{21}X_{22}X_{23}X_{24}X_{25}X_{26}X_{27}X_{28}X_{29}X_{30}$ | 315 |
| ZF4 | $X_1X_2X_3X_4X_5X_6X_7X_8X_9CX_{10}X_{11}CX_{12}X_{13}X_{14}X_{15}X_{16}$QRAHLERH$X_{17}X_{18}$ $X_{19}HX_{20}X_{21}X_{22}X_{23}X_{24}X_8X_9CX_{10}X_{11}CX_{12}X_{13}X_{14}X_{15}X_{16}$QLAHLRAH$X_{17}$ $X_{18}X_{19}HX_{20}X_{21}X_{22}X_{23}X_{24}X_8X_9CX_{10}X_{11}CX_{12}X_{13}X_{14}X_{15}X_{16}$SKKHLAE H$X_{17}X_{18}X_{19}HX_{20}X_{21}X_{22}X_{23}X_{24}X_8X_9CX_{10}X_{11}CX_{12}X_{13}X_{14}X_{15}X_{16}$TTGAL TEH$X_{17}X_{18}X_{19}HX_{20}X_{21}X_{22}X_{23}X_{24}X_8X_9CX_{10}X_{11}CX_{12}X_{13}X_{14}X_{15}X_{16}$TSG NLVRH$X_{17}X_{18}X_{19}HX_{20}X_{21}X_{22}X_{23}X_{24}X_8X_9CX_{10}X_{11}CX_{12}X_{13}X_{14}X_{15}X_{16}$ QSGDLRRH$X_{17}X_{18}X_{19}HX_{20}X_{21}X_{22}X_{23}X_{24}X_8X_9CX_{10}X_{11}CX_{12}X_{13}X_{14}X_{15}$ $X_{16}$TSHSLTEH$X_{17}X_{18}X_{19}HX_{20}X_{21}X_{22}X_{23}X_{24}X_{25}X_{26}X_{27}X_{28}X_{29}X_{30}$ | 316 |
| ZF5 | $X_1X_2X_3X_4X_5X_6X_7X_8X_9CX_{10}X_{11}CX_{12}X_{13}X_{14}X_{15}X_{16}$TSGNLTEH$X_{17}X_{18}$ $X_{19}HX_{20}X_{21}X_{22}X_{23}X_{24}X_8X_9CX_{10}X_{11}CX_{12}X_{13}X_{14}X_{15}X_{16}$DSGNLRVH$X_{17}$ $X_{18}X_{19}HX_{20}X_{21}X_{22}X_{23}X_{24}X_8X_9CX_{10}X_{11}CX_{12}X_{13}X_{14}X_{15}X_{16}$HKNALQN H$X_{17}X_{18}X_{19}HX_{20}X_{21}X_{22}X_{23}X_{24}X_8X_9CX_{10}X_{11}CX_{12}X_{13}X_{14}X_{15}X_{16}$RNDT LTEH$X_{17}X_{18}X_{19}HX_{20}X_{21}X_{22}X_{23}X_{24}X_8X_9CX_{10}X_{11}CX_{12}X_{13}X_{14}X_{15}X_{16}$QR AHLERH$X_{17}X_{18}X_{19}HX_{20}X_{21}X_{22}X_{23}X_{24}X_8X_9CX_{10}X_{11}CX_{12}X_{13}X_{14}X_{15}X_{16}$ RSDKLVRH$X_{17}X_{18}X_{19}HX_{20}X_{21}X_{22}X_{23}X_{24}X_8X_9CX_{10}X_{11}CX_{12}X_{13}X_{14}X_{15}$ $X_{16}$DPGHLVRH$X_{17}X_{18}X_{19}HX_{20}X_{21}X_{22}X_{23}X_{24}X_{25}X_{26}X_{27}X_{28}X_{29}X_{30}$ | 317 |
| ZF6 | $X_1X_2X_3X_4X_5X_6X_7X_8X_9CX_{10}X_{11}CX_{12}X_{13}X_{14}X_{15}X_{16}$TSHSLTEH$X_{17}X_{18}$ $X_{19}HX_{20}X_{21}X_{22}X_{23}X_{24}X_8X_9CX_{10}X_{11}CX_{12}X_{13}X_{14}X_{15}X_{16}$QRANLRAH$X_{17}$ $X_{18}X_{19}HX_{20}X_{21}X_{22}X_{23}X_{24}X_8X_9CX_{10}X_{11}CX_{12}X_{13}X_{14}X_{15}X_{16}$RADNLTE H$X_{17}X_{18}X_{19}HX_{20}X_{21}X_{22}X_{23}X_{24}X_8X_9CX_{10}X_{11}CX_{12}X_{13}X_{14}X_{15}X_{16}$ERSHL REH$X_{17}X_{18}X_{19}HX_{20}X_{21}X_{22}X_{23}X_{24}X_8X_9CX_{10}X_{11}CX_{12}X_{13}X_{14}X_{15}X_{16}$DPG ALVRHXI7$X_{18}X_{19}HX_{20}X_{21}X_{22}X_{23}X_{24}X_8X_9CX_{10}X_{11}CX_{12}X_{13}X_{14}X_{15}X_{16}$ TSGHLVRH$X_{17}X_{18}X_{19}HX_{20}X_{21}X_{22}X_{23}X_{24}X_8X_9CX_{10}X_{11}CX_{12}X_{13}X_{14}X_{15}$ $X_{16}$RNDTLTEH$X_{17}X_{18}X_{19}HX_{20}X_{21}X_{22}X_{23}X_{24}X_{25}X_{26}X_{27}X_{28}X_{29}X_{30}$ | 318 |
| ZF7 | $X_1X_2X_3X_4X_5X_6X_7X_8X_9CX_{10}X_{11}CX_{12}X_{13}X_{14}X_{15}X_{16}$RSDHLTNH$X_{17}X_{18}$ $X_{19}HX_{20}X_{21}X_{22}X_{23}X_{24}X_8X_9CX_{10}X_{11}CX_{12}X_{13}X_{14}X_{15}X_{16}$TSGSLVRH$X_{17}$ $X_{18}X_{19}HX_{20}X_{21}X_{22}X_{23}X_{24}X_8X_9CX_{10}X_{11}CX_{12}X_{13}X_{14}X_{15}X_{16}$QAGHLAS H$X_{17}X_{18}X_{19}HX_{20}X_{21}X_{22}X_{23}X_{24}X_8X_9CX_{10}X_{11}CX_{12}X_{13}X_{14}X_{15}X_{16}$RSDKL TEH$X_{17}X_{18}X_{19}HX_{20}X_{21}X_{22}X_{23}X_{24}X_8X_9CX_{10}X_{11}CX_{12}X_{13}X_{14}X_{15}X_{16}$TSG NLTEH$X_{17}X_{18}X_{19}HX_{20}X_{21}X_{22}X_{23}X_{24}X_8X_9CX_{10}X_{11}CX_{12}X_{13}X_{14}X_{15}X_{16}$Q SSNLVRH$X_{17}X_{18}X_{19}HX_{20}X_{21}X_{22}X_{23}X_{24}X_8X_9CX_{10}X_{11}CX_{12}X_{13}X_{14}X_{15}X_{16}$ THLDLIRH$X_{17}X_{18}X_{19}HX_{20}X_{21}X_{22}X_{23}X_{24}X_{25}X_{26}X_{27}X_{28}X_{29}X_{30}$ | 319 |
| ZF8 | $X_1X_2X_3X_4X_5X_6X_7X_8X_9CX_{10}X_{11}CX_{12}X_{13}X_{14}X_{15}X_{16}$RSDHLTTH$X_{17}X_{18}$ $X_{19}HX_{20}X_{21}X_{22}X_{23}X_{24}X_8X_9CX_{10}X_{11}CX_{12}X_{13}X_{14}X_{15}X_{16}$TSGELVRH$X_{17}$ $X_{18}X_{19}HX_{20}X_{21}X_{22}X_{23}X_{24}X_8X_9CX_{10}X_{11}CX_{12}X_{13}X_{14}X_{15}X_{16}$RRDELNV H$X_{17}X_{18}X_{19}HX_{20}X_{21}X_{22}X_{23}X_{24}X_8X_9CX_{10}X_{11}CX_{12}X_{13}X_{14}X_{15}X_{16}$SPADL TRH$X_{17}X_{18}X_{19}HX_{20}X_{21}X_{22}X_{23}X_{24}X_8X_9CX_{10}X_{11}CX_{12}X_{13}X_{14}X_{15}X_{16}$RSD | 320 |

TABLE 1B-continued

| Name of Exemplary Zinc Finger DNA Binding Domain | Amino Acid Sequence Structure | SEQ ID NO: |
|---|---|---|
| | ELVRHX$_{17}$X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$R SDKLVRHX$_{17}$X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$ X$_{16}$TTGALTEHX$_{17}$X$_{18}$X$_{19}$HX$_{20}$X$_{21}$X$_{22}$X$_{23}$X$_{24}$X$_{25}$X$_{26}$X$_{27}$X$_{28}$X$_{29}$X$_{30}$ | |
| ZF9 | X$_1$X$_2$X$_3$X$_4$X$_5$X$_6$X$_7$X$_8$X$_9$CX$_{10}$X$_{11}$CX$_{12}$X$_{13}$X$_{14}$X$_{15}$X$_{16}$QSGNLTEHX$_{17}$X$_{18}$ X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$HKNALQNHX$_{17}$ X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$QNSTLTE HX$_{17}$X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$SKKH LAEHX$_{17}$X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$TS GNLVRHX$_{17}$X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$ QSGHLTEHX$_{17}$X$_{18}$X$_{19}$HX$_{43}$X$_{44}$X$_{45}$X$_{46}$X$_{47}$X$_{48}$X$_{49}$X$_{50}$X$_{51}$X$_{52}$X$_{53}$X$_{54}$X$_{55}$ X$_{56}$X$_{57}$X58X8X$_9$CX$_{10}$X$_{11}$CX$_{12}$X$_{13}$X$_{14}$X$_{15}$X$_{16}$DKKDLTRHX$_{17}$X$_{18}$X$_{19}$HX$_{20}$ X$_{21}$X$_{22}$X$_{23}$X$_{24}$X$_{25}$X$_{26}$X$_{27}$X$_{28}$X$_{29}$X$_{30}$ | 321 |
| ZF10 | X$_1$X$_2$X$_3$X$_4$X$_5$X$_6$X$_7$X$_8$X$_9$CX$_{10}$X$_{11}$CX$_{12}$X$_{13}$X$_{14}$X$_{15}$X$_{16}$QNSTLTEHX$_{17}$X$_{18}$ X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$ERSHLREHX$_{17}$ X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$SKKHLAEH X$_{17}$X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$RNDTLT EHX$_{17}$X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$DCR DLARHX$_{17}$X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$ QSGDLRRHX$_{17}$X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$ X$_{16}$TKNSLTEHX$_{17}$X$_{18}$X$_{19}$HX$_{20}$X$_{21}$X$_{22}$X$_{23}$X$_{24}$X$_{25}$X$_{26}$X$_{27}$X$_{28}$X$_{29}$X$_{30}$ | 322 |
| ZF11 | X$_1$X$_2$X$_3$X$_4$X$_5$X$_6$X$_7$X$_8$X$_9$CX$_{10}$X$_{11}$CX$_{12}$X$_{13}$X$_{14}$X$_{15}$X$_{16}$ERSHLREHX$_{17}$X$_{18}$ X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$RADNLTEHX$_{17}$ X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$RSDKLTEH X$_{17}$X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$SKKHL AEHX$_{17}$X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$TK NSLTEHX$_{17}$X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$ DKKDLTRHX$_{17}$X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$ X$_{16}$SKKHLAEHX$_{17}$X$_{18}$X$_{19}$HX$_{20}$X$_{21}$X$_{22}$X$_{23}$X$_{24}$X$_{25}$X$_{26}$X$_{27}$X$_{28}$X$_{29}$X$_{30}$ | 323 |
| ZF12 | X$_1$X$_2$X$_3$X$_4$X$_5$X$_6$X$_7$X$_8$X$_9$CX$_{10}$X$_{11}$CX$_{12}$X$_{13}$X$_{14}$X$_{15}$X$_{16}$SKKHLAEHX$_{17}$X$_{18}$ X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$THLDLIRHX$_{17}$ X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$RKDNLKN HX$_{17}$X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$DCRD LARHX$_{17}$X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$RE DNLHTHX$_{17}$X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$ DPGHLVRHX$_{17}$X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$ X$_{16}$QLAHLRAHX$_{17}$X$_{18}$X$_{19}$HX$_{20}$X$_{21}$X$_{22}$X$_{23}$X$_{24}$X$_{25}$X$_{26}$X$_{27}$X$_{28}$X$_{29}$X$_{30}$ | 324 |
| ZF13 | X$_1$X$_2$X$_3$X$_4$X$_5$X$_6$X$_7$X$_8$X$_9$CX$_{10}$X$_{11}$CX$_{12}$X$_{13}$X$_{14}$X$_{15}$X$_{16}$RSDKLVRHX$_{17}$X$_{18}$ X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$QSGDLRRHX$_{17}$ X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$TSGELVRH X$_{17}$X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$RSDKLV RHX$_{17}$X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$DPG HLVRHX$_{17}$X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$ RNDALTEHX$_{17}$X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$ X$_{16}$RSDHLTNHX$_{17}$X$_{18}$X$_{19}$HX$_{20}$X$_{21}$X$_{22}$X$_{23}$X$_{24}$X$_{25}$X$_{26}$X$_{27}$X$_{28}$X$_{29}$X$_{30}$ | 325 |
| ZF14 | X$_1$X$_2$X$_3$X$_4$X$_5$X$_6$X$_7$X$_8$X$_9$CX$_{10}$X$_{11}$CX$_{12}$X$_{13}$X$_{14}$X$_{15}$X$_{16}$TSGHLVRHX$_{17}$X$_{18}$ X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$TTGNLTVHX$_{17}$ X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$TSGSLVRH X$_{17}$X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$RSDKLV RHX$_{17}$X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$RSDE LVRHX$_{17}$X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$RS DKLVRHX$_{17}$X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$ QRAHLERHX$_{17}$X$_{18}$X$_{19}$HX$_{20}$X$_{21}$X$_{22}$X$_{23}$X$_{24}$X$_{25}$X$_{26}$X$_{27}$X$_{28}$X$_{29}$X$_{30}$ | 326 |
| ZF15 | X$_1$X$_2$X$_3$X$_4$X$_5$X$_6$X$_7$X$_8$X$_9$CX$_{10}$X$_{11}$CX$_{12}$X$_{13}$X$_{14}$X$_{15}$X$_{16}$RNDTLTEHX$_{17}$X$_{18}$ X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$RNDALTEHX$_{17}$ X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$TSGELVRH X$_{17}$X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$RSDNLV RHX$_{17}$X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$RSDE LVRHX$_{17}$X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$RS DKLVRHX$_{17}$X$_{18}$X$_{19}$HX$_{20}$X$_{21}$X$_{22}$X$_{23}$X$_{24}$X$_8$X$_9$CX$_{10}$X$_{11}$CX$_{12}$X$_{13}$X$_{14}$X$_{15}$X$_{16}$ QSSNLVRHX$_{17}$X$_{18}$X$_{19}$11X$_{20}$X$_{21}$X$_{22}$X$_{23}$X$_{24}$X$_{25}$X$_{26}$X$_{27}$X$_{28}$X$_{29}$X$_{30}$ | 327 |

Similarly, the design and preparation of such TALE polypeptide which specifically bind to a DNA target region of interest, such as an HNF4α expression control region, is well known in the art. For example, the DNA binding domain of TALE contains a repeated highly conserved 33-34 amino acid sequence with divergent 12th and 13th amino acids. These two positions, referred to as the Repeat Variable Diresidue (RVD), are highly variable and show a strong correlation with specific nucleotide recognition. This straightforward relationship between amino acid sequence and DNA recognition has allowed for the engineering of specific DNA-binding domains by selecting a combination of repeat segments containing the appropriate RVDs. See, e.g., Boch J *Nature Biotechnology.* 29 (2) 2011: 135-6; Boch J, et al., *Science.* 326 (5959) 2009: 1509-12; Moscou M J & Bogdanove A J *Science.* 326 (5959) 2009: 1501.

In some embodiments, the site-specific HNF4α targeting moieties of the invention comprising a polynucleotide comprise a guide RNA (or gRNA) or nucleic acid encoding a guide RNA. A gRNA is a short synthetic RNA molecule comprising a "scaffold" sequence necessary for, e.g., directing an effector to an HNF4α expression control element which may, e.g., include an about 20 nucleotide site-specific sequence targeting a genomic target sequence comprising the HNF4α expression control element.

Generally, guide RNA sequences are designed to have a length of between about 17 to about 24 nucleotides (e.g., 19, 20, or 21 nucleotides) and are complementary to the target sequence. Custom gRNA generators and algorithms are available commercially for use in the design of effective guide RNAs. Gene editing has also been achieved using a chimeric "single guide RNA" ("sgRNA"), an engineered (synthetic) single RNA molecule that mimics a naturally occurring crRNA-tracrRNA complex and contains both a tracrRNA (for binding the nuclease) and at least one crRNA (to guide the nuclease to the sequence targeted for editing). Chemically modified sgNAs have also been demonstrated to be effective in genome editing; see, for example, Hendel et al. (2015) *Nature Biotechnol.,* 985-991.

Exemplary site-specific HNF4α promoter 1 targeting moieties are provided in Table 2, below. In some embodiments, the polynucleotide comprises a nucleotide sequence at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99% identical to the entire nucleotide sequence of any one of the nucleotide sequences in Table 2.

Exemplary site-specific HNF4α promoter 2 targeting moieties are provided in Table 3, below. In some embodiments, the polynucleotide comprises a nucleotide sequence at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99% identical to the entire nucleotide sequence of any one of the nucleotide sequences in Table 3.

Exemplary site-specific HNF4α promoter targeting moieties are also provided in Table 9, below. In some embodiments, the polynucleotide comprises a nucleotide sequence at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99% identical to the entire nucleotide sequence of any one of the nucleotide sequences in Table 9.

It will be understood that, although the sequences in Tables 2, 3, 4, and 9 are described as modified (or unmodified), the nucleic acid molecule encompassed by the of the invention, e.g., a site-specific disrupting agent, may comprise any one of the sequences set forth in any one of Tables 2, 3, 4, or 9 that is un-modified or modified differently than described therein. It will also be understood that although some of the sequences in Table 9 have "Ts", when used as an RNA molecule, such as a guide RNA, in the site-specific targeting moieties of the invention, the "Ts" may be replaced with "Us."

In some embodiments, a site-specific HNF4α targeting moiety comprising a polynucleotide, e.g., gRNA, comprises a nucleotide sequence complementary to an anchor sequence. In one embodiment, the anchor sequence comprises a CTCF-binding motif or consensus sequence:

(SEQ ID NO: 64)
N(T/C/G)N(G/A/T)CC(A/T/G)(C/G)(C/T/A)AG(G/A)(G/T)

GG(C/A/T)(G/A)(C/G)(C/T/A)(G/A/C), where N is any nucleotide. A CTCF-binding motif or consensus sequence may also be in the opposite orientation, e.g., (SEQ ID NO: 65)
(G/A/C)(C/T/A)(C/G)(G/A)(C/A/T)GG(G/T)(G/A)GA (C/T/A)(C/G)(A/T/G)CC(G/A/T)N(T/C/G)N.

In some embodiments, the nucleic acid sequence comprises a sequence complementary to a CTCF-binding motif or consensus sequence.

In some embodiments, the polynucleotide comprises a nucleotide sequence at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99% complementary to an anchor sequence.

In some embodiments, the polynucleotide comprises a nucleotide sequence at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99% complementary to a CTCF-binding motif or consensus sequence. In some embodiments, the polynucleotide is selected from the group consisting of a gRNA, and a sequence complementary or a sequence comprising at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99% complementary sequence to an anchor sequence.

In some embodiments, a site-specific HNF4α targeting moiety comprising a polynucleotide of the invention is an RNAi molecule. RNAi molecules comprise RNA or RNA-like structures typically containing 15-50 base pairs (such as about 18-25 base pairs) and having a nucleobase sequence identical (complementary) or nearly identical (substantially complementary) to a coding sequence in an expressed target gene within the cell. RNAi molecules include, but are not limited to: short interfering RNAs (siRNAs), double-strand RNAs (dsRNA), micro RNAs (miRNAs), short hairpin RNAs (shRNA), meroduplexes, and dicer substrates (U.S. Pat. Nos. 8,084,599, 8,349,809, and 8,513,207). In one embodiment, the invention includes a composition to inhibit expression of a gene encoding a polypeptide described herein, e.g., a conjunction nucleating molecule.

RNAi molecules comprise a sequence substantially complementary, or fully complementary, to all or a fragment of a target gene. RNAi molecules may complement sequences at the boundary between introns and exons to prevent the maturation of newly-generated nuclear RNA transcripts of specific genes into mRNA for transcription. RNAi molecules complementary to specific genes can hybridize with the mRNA for that gene and prevent its translation. The antisense molecule can be DNA, RNA, or a derivative or hybrid thereof. Examples of such derivative molecules include, but are not limited to, peptide nucleic acid (PNA) and phosphorothioate-based molecules such as deoxyribonucleic guanidine (DNG) or ribonucleic guanidine (R G).

RNAi molecules can be provided to the cell as "ready-to-use" RNA synthesized in vitro or as an antisense gene transfected into cells which will yield RNAi molecules upon transcription. Hybridization with mRNA results in degradation of the hybridized molecule by RNAse H and/or inhibition of the formation of translation complexes. Both result in a failure to produce the product of the original gene.

The length of the RNAi molecule that hybridizes to the transcript of interest should be around 10 nucleotides, between about 15 or 30 nucleotides, or about 15, 16, 17, 18, 19, 20, 21, 22, 23, 24, 25, 26, 27, 28, 29, 30 or more nucleotides. The degree of identity of the antisense sequence to the targeted transcript should be at least 75%, at least 80%, at least 85%, at least 90%, or at least 95.

RNAi molecules may also comprise overhangs, i.e. typically unpaired, overhanging nucleotides which are not directly involved in the double helical structure normally formed by the core sequences of the herein defined pair of sense strand and antisense strand. RNAi molecules may contain 3' and/or 5' overhangs of about 1-5 bases independently on each of the sense strands and antisense strands. In one embodiment, both the sense strand and the antisense strand contain 3' and 5' overhangs. In one embodiment, one or more of the 3' overhang nucleotides of one strand base pairs with one or more 5' overhang nucleotides of the other strand. In another embodiment, the one or more of the 3' overhang nucleotides of one strand base do not pair with the one or more 5' overhang nucleotides of the other strand. The sense and antisense strands of an RNAi molecule may or may not contain the same number of nucleotide bases. The antisense and sense strands may form a duplex wherein the 5' end only has a blunt end, the 3' end only has a blunt end, both the 5' and 3' ends are blunt ended, or neither the 5' end nor the 3' end are blunt ended. In another embodiment, one or more of the nucleotides in the overhang contains a thiophosphate, phosphorothioate, deoxynucleotide inverted (3' to 3' linked) nucleotide or is a modified ribonucleotide or deoxynucleotide.

Small interfering RNA (siRNA) molecules comprise a nucleotide sequence that is identical to about 15 to about 25 contiguous nucleotides of the target mRNA. In some embodiments, the siRNA sequence commences with the dinucleotide AA, comprises a GC-content of about 30-70% (about 50-60%, about 40-60%, or about 45%-55%), and does not have a high percentage identity to any nucleotide sequence other than the target in the genome of the mammal in which it is to be introduced, for example as determined by standard BLAST search.

siRNAs and shRNAs resemble intermediates in the processing pathway of the endogenous microRNA (miRNA) genes (Bartel, Cell 116:281-297, 2004). In some embodiments, siRNAs can function as miRNAs and vice versa (Zeng et al., Mol Cell 9: 1327-1333, 2002; Doench et al., Genes Dev 17:438-442, 2003). MicroRNAs, like siRNAs, use RISC to downregulate target genes, but unlike siRNAs, most animal miRNAs do not cleave the mRNA. Instead, miRNAs reduce protein output through translational suppression or polyA removal and mRNA degradation (Wu et al., Proc Natl Acad Sci USA 103:4034-4039, 2006). Known miRNA binding sites are within mRNA 3' UTRs; miRNAs seem to target sites with near-perfect complementarity to nucleotides 2-8 from the miRNA's 5' end (Rajewsky, Nat Genet 38 Suppl: S8-13, 2006; Lim et al, Nature 433:769-773, 2005). This region is known as the seed region. Because siRNAs and miRNAs are interchangeable, exogenous siRNAs downregulate mRNAs with seed complementarity to the siRNA (Birmingham et al., Nat Methods 3: 199-204, 2006. Multiple target sites within a 3' UTR give stronger downregulation (Doench et al., Genes Dev 17:438-442, 2003).

Lists of known miRNA sequences can be found in databases maintained by research organizations, such as Wellcome Trust Sanger Institute, Perm Center for Bioinformatics, Memorial Sloan Kettering Cancer Center, and European Molecule Biology Laboratory, among others. Known effective siRNA sequences and cognate binding sites are also well represented in the relevant literature. RNAi molecules are readily designed and produced by technologies known in the art. In addition, there are computational tools that increase the chance of finding effective and specific sequence motifs (Pei et al. 2006, Reynolds et al. 2004, Khvorova et al. 2003, Schwarz et al. 2003, Ui-Tei et al. 2004, Heale et al. 2005, Chalk et al. 2004, Amarzguioui et al. 2004).

An RNAi molecule modulates expression of RNA encoded by a gene. Because multiple genes can share some degree of sequence homology with each other, in some embodiments, the RNAi molecule can be designed to target a class of genes with sufficient sequence homology. In some embodiments, the RNAi molecule can contain a sequence that has complementarity to sequences that are shared amongst different gene targets or are unique for a specific gene target. In some embodiments, the RNAi molecule can be designed to target conserved regions of an RNA sequence having homology between several genes thereby targeting several genes in a gene family (e.g., different gene isoforms, splice variants, mutant genes, etc.). In some embodiments, the RNAi molecule can be designed to target a sequence that is unique to a specific RNA sequence of a single gene.

In some embodiments, the RNAi molecule targets a sequence in a conjunction nucleating molecule, e.g., CTCF, cohesin, USF 1, YY1, TATA-box binding protein associated factor 3 (TAF3), ZNF 143, or another polypeptide that promotes the formation of an anchor sequence-mediated conjunction, or an epigenetic modifying agent, e.g., an enzyme involved in post-translational modifications including, but are not limited to, DNA methylases (e.g., DNMT3a, DNMT3b, DNMTL), DNA demethylation (e.g., the TET family enzymes catalyze oxidation of 5-methylcytosine to 5-hydroxymethylcytosine and higher oxidative derivatives), histone methyltransferases, histone deacetylase (e.g., HDAC1, HDAC2, HDAC3), sirtuin 1, 2, 3, 4, 5, 6, or 7, lysine-specific histone demethylase 1 (LSD1), histone-lysine-N-methyltransferase (Setdbl), euchromatic histone-lysine N-methyltransferase 2 (G9a), histone-lysine N-methyltransferase (SUV39H1), enhancer of zeste homolog 2 (EZH2), viral lysine methyltransferase (vSET), histone methyltransferase (SET2), protein-lysine N-methyltransferase (SMYD2), and others. In one embodiment, the RNAi molecule targets a protein deacetylase, e.g., sirtuin 1, 2, 3, 4, 5, 6, or 7. In one embodiment, the invention includes a composition comprising an RNAi that targets a conjunction nucleating molecule, e.g., CTCF.

In some embodiments, the site-specific HNF4α targeting moiety comprises a peptide or protein moiety. In some embodiments, a site-specific disrupting agent comprises a fusion protein. In some embodiments, an effector is ca peptide or protein moiety. The peptide or protein moieties may include, but is not limited to, a peptide ligand, antibody fragment, or targeting aptamer that binds a receptor such as an extracellular receptor, neuropeptide, hormone peptide, peptide drug, toxic peptide, viral or microbial peptide, synthetic peptide, and agonist or antagonist peptide.

Exemplary peptides or protein include a DNA-binding protein, a CRISPR component protein, a conjunction nucleating molecule, a dominant negative conjunction nucleating molecule, an epigenetic modifying agent, or any combination thereof. In some embodiments, the peptide comprises a nuclease, a physical blocker, an epigenetic recruiter, and an epigenetic CpG modifier, and fragments and combinations of any of the foregoing. In some embodiments, the peptide comprises a DNA-binding domain of a protein, such as a helix-turn-helix motif, a leucine zipper, a Zn-finger, a TATA box binding proteins, a transcription factor.

Peptides or proteins may be linear or branched. The peptide or protein moiety may have a length from about 5 to about 200 amino acids, about 15 to about 150 amino acids, about 20 to about 125 amino acids, about 25 to about 100 amino acids, 20-70 amino acids, 20-80 amino acids, 20-90 amino acids, 30-100 amino acids, 30-60 amino acids, 30-80 amino acids, 35-85 amino acids, 40-100 amino acids, or 50-125 amino acids or any range therebetween.

As indicated above, in some embodiments, the site-specific HNF4α targeting moieties of the invention comprise a fusion protein.

In some embodiments, the fusion proteins of the invention include a site-specific HNF4α targeting moiety which targets an HNF4α expression control region and an effector molecule. In other embodiments, a fusion protein of the invention comprises an effector molecule. Exemplary effector molecules include are described below and in some embodiments include, for example, nucleases, physical blockers, epigenetic recruiters, e.g., a transcriptional enhancer or a transcriptional repressor, and epigenetic CpG modifiers, e.g., a DNA methylate, a DNA demethylase, a histone modifying agent, or a histone deacetylase, and combinations of any of the foregoing.

For example, a site-specific targeting moiety may comprise a gRNA and an effector, such as a nuclease, e.g., a Cas9, e.g., a wild type Cas9, a nickase Cas9 (e.g., Cas9 D10A), a dead Cas9 (dCas9), eSpCas9, Cpf1, C2C1, or C2C3, or a nucleic acid encoding such a nuclease. The choice of nuclease and gRNA(s) is determined by whether the targeted mutation is a deletion, substitution, or addition of nucleotides, e.g., a deletion, substitution, or addition of nucleotides to a targeted sequence. Fusions of a catalytically inactive endonuclease e.g., a dead Cas9 (dCas9, e.g., D10A; H840A) tethered with all or a portion of (e.g., biologically active portion of) an (one or more) effector domain create chimeric proteins that can be linked to the polypeptide to guide the composition to specific DNA sites by one or more RNA sequences (e.g., DNA recognition elements including, but not restricted to zinc finger arrays, sgRNA, TAL arrays, peptide nucleic acids described herein) to modulate activity and/or expression of one or more target nucleic acids sequences (e.g., to methylate or demethylate a DNA sequence).

In one embodiment, a fusion protein of the invention may comprise an effector molecule comprising, for example, a CRISPR associated protein (Cas) polypeptide, or fragment thereof, (e.g., a Cas9 polypeptide, or fragment thereof) and an epigenetic recruiter or an epigenetic CpG modifier.

In one embodiment, a suitable Cas polypeptide is an enzymatically inactive Cas polypeptide, e.g., a "dead Cas polypeptide" or "dCas" polypeptide Exemplary Cas polypeptides that are adaptable to the methods and compositions described herein are described below. Using methods known in the art, a Cas polypeptide can be fused to any of a variety of agents and/or molecules as described herein; such resulting fusion molecules can be useful in various disclosed methods.

In one aspect, the invention includes a composition comprising a protein comprising a domain, e.g., an effector, that acts on DNA (e.g., a nuclease domain, e.g., a Cas9 domain, e.g., a dCas9 domain; a DNA methyltransferase, a demethylase, a deaminase), in combination with at least one guide RNA (gRNA) or antisense DNA oligonucleotide that targets the protein to site-specific target sequence, wherein the composition is effective to alter, in a human cell, the expression of a target gene. In some embodiments, the enzyme domain is a Cas9 or a dCas9. In some embodiments, the protein comprises two enzyme domains, e.g., a dCas9 and a methylase or demethylase domain.

In one aspect, the invention includes a composition comprising a protein comprising a domain, e.g., an effector, that comprises a transcriptional control element (e.g., a nuclease domain, e.g., a Cas9 domain, e.g., a dCas9 domain; a transcriptional enhancer; a transcriptional repressor), in combination with at least one guide RNA (gRNA) or antisense DNA oligonucleotide that targets the protein to a site-specific target sequence, wherein the composition is effective to alter, in a human cell, the expression of a target gene. In some embodiments, the enzyme domain is a Cas9 or a dCas9. In some embodiments, the protein comprises two enzyme domains, e.g., a dCas9 and a transcriptional enhancer or transcriptional repressor domain.

As used herein, a "biologically active portion of an effector domain" is a portion that maintains the function (e.g. completely, partially, minimally) of an effector domain (e.g., a "minimal" or "core" domain).

The chimeric proteins described herein may also comprise a linker, e.g., an amino acid linker. In some aspects, a linker comprises 2 or more amino acids, e.g., one or more GS sequences. In some aspects, fusion of Cas9 (e.g., dCas9) with two or more effector domains (e.g., of a DNA methylase or enzyme with a role in DNA demethylation or protein acetyl transferase or deacetylase) comprises one or more interspersed linkers (e.g., GS linkers) between the domains. In some aspects, dCas9 is fused with 2-5 effector domains with interspersed linkers.

In some embodiments, a site-specific HNF4α targeting moiety comprises a conjunction nucleating molecule, a nucleic acid encoding a conjunction nucleating molecule, or a combination thereof. In some embodiments, an anchor sequence-mediated conjunction is mediated by a first conjunction nucleating molecule bound to the first anchor sequence, a second conjunction nucleating molecule bound to the noncontiguous second anchor sequence, and an association between the first and second conjunction nucleating molecules. In some embodiments, a conjunction nucleating molecule may disrupt, e.g., by competitive binding, the binding of an endogenous conjunction nucleating molecule to its binding site.

The conjunction nucleating molecule may be, e.g., CTCF, cohesin, USF1, YY1, TATA-box binding protein associated factor 3 (TAF3), ZNF143 binding motif, or another polypeptide that promotes the formation of an anchor sequence-mediated conjunction. The conjunction nucleating molecule may be an endogenous polypeptide or other protein, such as a transcription factor, e.g., autoimmune regulator (AIRE), another factor, e.g., X-inactivation specific transcript (XIST), or an engineered polypeptide that is engineered to recognize a specific DNA sequence of interest, e.g., having a zinc finger, leucine zipper or bHLH domain for sequence recognition. The conjunction nucleating molecule may modulate DNA interactions within or around the anchor sequence-mediated conjunction. For example, the conjunction nucleating molecule can recruit other factors to the anchor sequence that alters an anchor sequence-mediated conjunction formation or disruption.

The conjunction nucleating molecule may also have a dimerization domain for homo- or heterodimerization. One or more conjunction nucleating molecules, e.g., endogenous and engineered, may interact to form the anchor sequence-mediated conjunction. In some embodiments, the conjunction nucleating molecule is engineered to further include a stabilization domain, e.g., cohesion interaction domain, to stabilize the anchor sequence-mediated conjunction. In some embodiments, the conjunction nucleating molecule is engineered to bind a target sequence, e.g., target sequence binding affinity is modulated. In some embodiments, the conjunction nucleating molecule is selected or engineered with a selected binding affinity for an anchor sequence within the anchor sequence-mediated conjunction. Conjunction nucleating molecules and their corresponding anchor sequences may be identified through the use of cells that harbor inactivating mutations in CTCF and Chromosome Conformation Capture or 3C-based methods, e.g., Hi-C or high-throughput sequencing, to examine topologically associated domains, e.g., topological interactions between distal DNA regions or loci, in the absence of CTCF. Long-range DNA interactions may also be identified. Additional analyses may include Ch1A-PET analysis using a bait, such as Cohesin, YY1 or USF1, ZNF143 binding motif, and MS to identify complexes that are associated with the bait.

B. Effector Molecules

Effector molecules for use in the compositions and methods of the invention include those that modulate a biological activity, for example increasing or decreasing enzymatic activity, gene expression, cell signalling, and cellular or organ function. Preferred effector molecules of the invention are nucleases, physical blockers, epigenetic recruiters, e.g., a transcriptional enhancer or a transcriptional repressor, and epigenetic CpG modifiers, e.g., a DNA methylase, a DNA demethylase, a histone modifying agent, or a histone deacetylase, and combinations of any of the foregoing.

Additional effector effector activities of the effector molecules of the invention may also include binding regulatory proteins to modulate activity of the regulator, such as transcription or translation. Effector molecules also may include activator or inhibitor (or "negative effector") functions as described herein. For example, the effector molecule may inhibit substrate binding to a receptor and inhibit its activation, e.g., naltrexone and naloxone bind opioid receptors without activating them and block the receptors' ability to bind opioids. Effector molecules may also modulate protein stability/degradation and/or transcript stability/degradation. For example, proteins may be targeted for degradation by the polypeptide co-factor, ubiquitin, onto proteins to mark them for degradation. In another example, an effector molecule inhibits enzymatic activity by blocking the enzyme's active site, e.g., methotrexate is a structural analog of tetrahydrofolate, a coenzyme for the enzyme dihydrofolate reductase that binds to dihydrofolate reductase 1000-fold more tightly than the natural substrate and inhibits nucleotide base synthesis.

In some embodiments, the effector molecule is a chemical, e.g., a chemical that modulates a cytosine (C) or an adenine (A) (e.g., Na bisulfite, ammonium bisulfite). In some embodiments, the effector molecule has enzymatic activity (methyl transferase, demethylase, nuclease (e.g., Cas9), a deaminase). In some embodiments, the effector molecule sterically hinders formation of an anchor sequence-mediated conjunction or binding of an RNA polymerase to a promoter.

The effector molecule with effector activity may be any one of the small molecules, peptides, fusion proteins, nucleic acids, nanoparticle, aptamers, or pharmacoagents with poor PK/PD described herein.

In some embodiments, the effector molecule is an inhibitor or "negative effector molecule". In the context of a negative effector molecule that modulates formation of an anchor sequence-mediated conjunction, in some embodiments, the negative effector molecule is characterized in that dimerization of an endogenous nucleating polypeptide is reduced when the negative effector molecule is present as compared with when it is absent. For example, in some embodiments, the negative effector molecule is or comprises a variant of the endogenous nucleating polypeptide's dimerization domain, or a dimerizing portion thereof.

For example, in certain embodiments, an anchor sequence-mediated conjunction is altered (e.g., disrupted) by use of a dominant negative effector, e.g., a protein that recognizes and binds an anchor sequence, (e.g., a CTCF binding motif), but with an inactive (e.g., mutated) dimerization domain, e.g., a dimerization domain that is unable to form a functional anchor sequence-mediated conjunction. For example, the Zinc Finger domain of CTCF can be altered so that it binds a specific anchor sequence (by adding zinc fingers that recognize flanking nucleic acids), while the homo-dimerization domain is altered to prevent the interaction between the engineered CTCF and endogenous forms of CTCF.

In some embodiments, the effector molecule comprises a synthetic conjunction nucleating molecule with a selected binding affinity for an anchor sequence within a target anchor sequence-mediated conjunction, (the binding affinity may be at least 10%, 15%, 20%, 25%, 30%, 35%, 40%, 45%, 50%, 55%, 60%, 65%, 70%, 75%, 80%, 85%, 90%, 95%, or higher or lower than the affinity of an endogenous conjunction nucleating molecule that associates with the target anchor sequence. The synthetic conjunction nucleating molecule may have between 30-90%, 30-85%, 30-80%, 30-70%, 50-80%, 50-90% amino acid sequence identity to the endogenous conjunction nucleating molecule). The conjunction nucleating molecule may disrupt, such as through competitive binding, the binding of an endogenous conjunction nucleating molecule to its anchor sequence. In some more embodiments, the conjunction nucleating molecule is engineered to bind a novel anchor sequence within the anchor sequence-mediated conjunction.

In some embodiments, a dominant negative effector molecule has a domain that recognizes specific DNA sequences (e.g., an anchor sequence, a CTCF anchor sequence, flanked by sequences that confer sequence specificity), and a second domain that provides a steric presence in the vicinity of the anchoring sequence. The second domain may include a dominant negative conjunction nucleating molecule or fragment thereof, a polypeptide that interferes with conjunction nucleating molecule sequence recognition (e.g., the amino acid backbone of a peptide/nucleic acid or PNA), a nucleic acid sequence ligated to a small molecule that imparts steric interference, or any other combination of DNA recognition elements and a steric blocker.

In some embodiments, the effector molecule is an epigenetic modifying agent. Epigenetic modifying agents useful in the methods and compositions described herein include agents that affect, e.g., DNA methylation, histone acetylation, and RNA-associated silencing. In some embodiments, the effectors sequence-specifically target an epigenetic enzyme (e.g., an enzyme that generates or removes epigenetic marks, e.g., acetylation and/or methylation). Exemplary epigenetic effectors may target an expression control region comprising, e.g., a transcriptional control element or an anchor sequence, by a site-specific disrupting agent comprising a site-specific targeting moiety.

In some embodiments, an effector molecule comprises one or more components of a gene editing system. Components of gene editing systems may be used in a variety of contexts including but not limited to gene editing. For example, such components may be used to target agents that physically modify, genetically modify, and/or epigenetically modify HNF4α sequences.

Exemplary gene editing systems include the clustered regulatory interspaced short palindromic repeat (CRISPR) system, zinc finger nucleases (ZFNs), and Transcription Activator-Like Effector-based Nucleases (TALEN). ZFNs, TALENs, and CRISPR-based methods are described, e.g., in Gaj et al. Trends Biotechnol. 31.7(2013):397-405; CRISPR methods of gene editing are described, e.g., in Guan et al, Application of CRISPR-Cas system in gene therapy: Preclinical progress in animal model. DNA Repair 2016 Jul. 30 [Epub ahead of print]; Zheng et al, Precise gene deletion and replacement using the CRISPR/Cas9 system in human cells. BioTechniques, Vol. 57, No. 3, September 2014, pp. 115-124.

CRISPR systems are adaptive defense systems originally discovered in bacteria and archaea. CRISPR systems use RNA-guided nucleases termed CRISPR-associated or "Cas" endonucleases (e. g., Cas9 or Cpf1) to cleave foreign DNA. In a typical CRISPR/Cas system, an endonuclease is directed to a target nucleotide sequence (e. g., a site in the genome that is to be sequence-edited) by sequence-specific, non-coding "guide RNAs" that target single- or double-stranded DNA sequences. Three classes (I-III) of CRISPR systems have been identified. The class II CRISPR systems use a single Cas endonuclease (rather than multiple Cas proteins). One class II CRISPR system includes a type II Cas endonuclease such as Cas9, a CRISPR RNA ("crRNA"), and a trans-activating crRNA ("tracrRNA"). The crRNA contains a "guide RNA", typically about 20-nucleotide RNA sequence that corresponds to a target DNA sequence. The crRNA also contains a region that binds to the tracrRNA to form a partially double-stranded structure which is cleaved by RNase III, resulting in a crRNA/tracrRNA hybrid. The crRNA/tracrRNA hybrid then directs the Cas9 endonuclease to recognize and cleave the target DNA sequence. The target DNA sequence must generally be adjacent to a "protospacer adjacent motif ("PAM") that is specific for a given Cas endonuclease; however, PAM sequences appear throughout a given genome. CRISPR endonucleases identified from various prokaryotic species have unique PAM sequence requirements; examples of PAM sequences include 5'-NGG (Streptococcus pyogenes), 5'-NNAGAA (Streptococcus thermophilus CRISPR1), 5'-NGGNG (Streptococcus thermophilus CRISPR3), and 5'-NNNGATT (Neisseria meningiditis). Some endonucleases, e. g., Cas9 endonucleases, are associated with G-rich PAM sites, e. g., 5'-NGG, and perform blunt-end cleaving of the target DNA at a location 3 nucleotides upstream from (5' from) the PAM site. Another class II CRISPR system includes the type V endonuclease Cpf1, which is smaller than Cas9; examples include AsCpf1 (from Acidaminococcus sp.) and LbCpf1 (from Lachnospiraceae sp.). Cpf 1-associated CRISPR arrays are processed into mature crRNAs without the requirement of a tracrRNA; in other words a Cpf1 system requires only the Cpf1 nuclease and a crRNA to cleave the target DNA sequence. Cpf1 endonucleases, are associated with T-rich PAM sites, e. g., 5'-TTN. Cpf1 can also recognize a 5'-CTA PAM motif. Cpf1 cleaves the target DNA by introducing an offset or staggered double-strand break with a 4- or 5-nucleotide 5' overhang, for example, cleaving a target DNA with a 5-nucleotide offset or staggered cut located 18 nucleotides downstream from (3' from) from the PAM site on the coding strand and 23 nucleotides downstream from the PAM site on the complimentary strand; the 5-nucleotide overhang that results from such offset cleavage allows more precise genome editing by DNA insertion by homologous recombination than by insertion at blunt-end cleaved DNA. See, e. g., Zetsche et al. (2015) Cell, 163:759-771.

A variety of CRISPR associated (Cas) genes or proteins can be used in the present invention and the choice of Cas protein will depend upon the particular conditions of the method.

Specific examples of Cas proteins include class II systems including Cas1, Cas2, Cas3, Cas4, Cas5, Cas6, Cas7, Cas8, Cas9, Cask), Cpf1, C2C1, or C2C3. In some embodiments, a Cas protein, e.g., a Cas9 protein, may be from any of a variety of prokaryotic species. In some embodiments a particular Cas protein, e.g., a particular Cas9 protein, is selected to recognize a particular protospacer-adjacent motif (PAM) sequence. In some embodiments, the site-specific targeting moiety includes a sequence targeting polypeptide, such as an enzyme, e.g., Cas9. In certain embodiments a Cas protein, e.g., a Cas9 protein, may be obtained from a bacteria or archaea or synthesized using known methods.

In certain embodiments, a Cas protein may be from a gram positive bacteria or a gram negative bacteria. In certain embodiments, a Cas protein may be from a Streptococcus, (e.g., a S. pyogenes, a S. thermophilus) a Crptococcus, a Corynebacterium, a Haemophilus, a Eubacterium, a Pasteurella, a Prevotella, a Veillonella, or a Marinobacter. In some embodiments nucleic acids encoding two or more different Cas proteins, or two or more Cas proteins, may be introduced into a cell, zygote, embryo, or animal, e.g., to allow for recognition and modification of sites comprising the same, similar or different PAM motifs. In some embodiments, the Cas protein is modified to deactivate the nuclease, e.g., nuclease-deficient Cas9, and to recruit transcription activators or repressors, e.g., the co-subunit of the E. coli Pol, VP64, the activation domain of p65, KRAB, or SID4X, to induce epigenetic modifications, e.g., histone acetyltransferase, histone methyltransferase and demethylase, DNA methyltransferase and enzyme with a role in DNA demethylation (e.g., the TET family enzymes catalyze oxidation of 5-methylcytosine to 5-hydroxymethylcytosine and higher oxidative derivatives).

For the purposes of gene editing, CRISPR arrays can be designed to contain one or multiple guide RNA sequences corresponding to a desired target DNA sequence; see, for example, Cong et al. (2013) Science, 339:819-823; Ran et al. (2013) Nature Protocols, 8:2281-2308. At least about 16 or 17 nucleotides of gRNA sequence are required by Cas9 for DNA cleavage to occur; for Cpf1 at least about 16 nucleotides of gRNA sequence is needed to achieve detectable DNA cleavage.

Whereas wild-type Cas9 generates double-strand breaks (DSBs) at specific DNA sequences targeted by a gRNA, a number of CRISPR endonucleases having modified functionalities are available, for example: a "nickase" version of Cas9 generates only a single-strand break; a catalytically inactive Cas9 ("dCas9") does not cut the target DNA but interferes with transcription by steric hindrance. dCas9 can further be fused with a heterologous effector to repress (CRISPRi) or activate (CRISPRa) expression of a target gene. For example, Cas9 can be fused to a transcriptional silencer (e.g., a KRAB domain) or a transcriptional activator (e.g., a dCas9-VP64 fusion). A catalytically inactive Cas9 (dCas9) fused to Fok1 nuclease ("dCas9-FokI") can be used to generate DSBs at target sequences homologous to two gRNAs. See, e. g., the numerous CRISPR/Cas9 plasmids disclosed in and publicly available from the Addgene repository (Addgene, 75 Sidney St., Suite 550A, Cambridge, MA 02139; addgene.org/crispr). A "double nickase" Cas9 that introduces two separate double-strand breaks, each directed by a separate guide RNA, is described as achieving more accurate genome editing by Ran et al. (2013) Cell, 154: 1380-1389.

CRISPR technology for editing the genes of eukaryotes is disclosed in US Patent Application Publications 2016/0138008A1 and US2015/0344912A1, and in U.S. Pat. Nos. 8,697,359, 8,771,945, 8,945,839, 8,999,641, 8,993,233, 8,895,308, 8,865,406, 8,889,418, 8,871,445, 8,889,356, 8,932,814, 8,795,965, and 8,906,616. Cpf1 endonuclease and corresponding guide RNAs and PAM sites are disclosed in US Patent Application Publication 2016/0208243 A1.

In some embodiments, an effector comprises one or more components of a CRISPR system described hereinabove.

In some embodiments, suitable effectors for use in the agents, compositions, and methods of the invention include, for example, nucleases, physical blockers, epigenetic recruiters, e.g., a transcriptional enhancer or a transcriptional repressor, and epigenetic CpG modifiers, e.g., a DNA methylase, a DNA demethylase, a histone modifying agent, or a histone deacetylase, and combinations of any of the foregoing.

Suitable effectors include a polypeptide or its variant. The term "variant," as used herein, refers to a polypeptide that is derived by incorporation of one or more amino acid insertions, substitutions, or deletions in a precursor polypeptide (e.g., "parent" polypeptide). In certain embodiments, a variant polypeptide has at least about 85% amino acid sequence identity, e.g., about 90%, about 91%, about 92%, about 93%, about 94%, about 95%, about 96%, about 97%, about 98%, about 99%, or about 100%, amino acid sequence identity to the entire amino acid sequence of a parent polypeptide.

The term "sequence identity," as used herein, refers to a comparison between pairs of nucleic acid or amino acid molecules, i.e., the relatedness between two amino acid sequences or between two nucleotide sequences. In general, the sequences are aligned so that the highest order match is obtained. Methods for determining sequence identity are known and can be determined by commercially available computer programs that can calculate the percentage of identity between two or more sequences. A typical example of such a computer program is CLUSTAL.

Exemplary effectors include ubiquitin, bicyclic peptides as ubiquitin ligase inhibitors, transcription factors, DNA and protein modification enzymes such as topoisomerases, topoisomerase inhibitors such as topotecan, DNA methyltransferases such as the DNMT family (e.g., DNMT3a, DNMT3b, DNMTL), protein methyltransferases (e.g., viral lysine methyltransferase (vSET), protein-lysine N-methyltransferase (SMYD2), deaminases (e.g., APOBEC, UG1), histone methyltransferases such as enhancer of zeste homolog 2 (EZH2), PRMT1, histone-lysine-N-methyltransferase (Setdb1), histone methyltransferase (SET2), euchromatic histone-lysine N-methyltransferase 2 (G9a), histone-lysine N-methyltransferase (SUV39H1), and G9a), histone deacetylase (e.g., HDAC1, HDAC2, HDAC3), enzymes with a role in DNA demethylation (e.g., the TET family enzymes catalyze oxidation of 5-methylcytosine to 5-hydroxymethylcytosine and higher oxidative derivatives), protein demethylases such as KDMIA and lysine-specific histone demethylase 1 (LSD1), helicases such as DHX9, acetyltransferases, deacetylases (e.g., sirtuin 1, 2, 3, 4, 5, 6, or 7), kinases, phosphatases, DNA-intercalating agents such as ethidium bromide, sybr green, and proflavine, efflux pump inhibitors such as peptidomimetics like phenylalanine arginyl-naphthylamide or quinoline derivatives, nuclear receptor activators and inhibitors, proteasome inhibitors, competitive inhibitors for enzymes such as those involved in lysosomal storage diseases, zinc finger proteins, TALENs, specific domains from proteins, such as a KRAB domain, a VP64 domain, a p300 domain (e.g., p300 core domain), an MeCP2 domain, an MQ1 domain, a DNMT3a-3L domain a TET1 domain, and a TET2 domain, protein synthesis inhibitors, nucleases (e.g., Cpf1, Cas9, zinc finger nuclease), fusions of one or more thereof (e.g., dCas9-DNMT, dCas9-APOBEC, dCas9-UG1, dCas9-VP64, dCas9-p300 core, dCas9-KRAB, dCas9-KRAB-MeCP2, dCas9-MQ1, dCas9-DNMT3a-3L, dCAS9-TET1, dCAS9-TET2, and dCas9-MC/MN).

In some embodiments, a suitable nuclease for use in the agent, compositions, and methods of the invention comprises a Cas9 polypeptide, or enzymatically active portion thereof. In one embodiment, the Cas9 polypeptide, or enzymatically active portion thereof, further comprises a catalytically active domain of human exonuclease 1 (hEXO1), e.g., 5' to 3' exonuclease activity and/or an RNase H activity. In other embodiments, a suitable nuclease comprises a transcription activator like effector nucleases (TALEN). In yet other embodiments, a suitable nuclease comprises a zinc finger protein.

The term TALEN, as used herein, is broad and includes a monomeric TALEN that can cleave double stranded DNA without assistance from another TALEN. The term TALEN is also used to refer to one or both members of a pair of TALENs that are engineered to work together to cleave DNA at the same site. TALENs that work together may be referred to as a left-TALEN and a right-TALEN, which references the handedness of DNA. See U.S. Ser. No. 12/965,590; U.S. Ser. No. 13/426,991 (U.S. Pat. No. 8,450,471); U.S. Ser. No. 13/427,040 (U.S. Pat. No. 8,440,431); U.S. Ser. No. 13/427,137 (U.S. Pat. No. 8,440,432); and U.S. Ser. No. 13/738,381, all of which are incorporated by reference herein in their entirety.

TAL effectors are proteins secreted by *Xanthomonas* bacteria. The DNA binding domain contains a highly conserved 33-34 amino acid sequence with the exception of the 12th and 13th amino acids. These two locations are highly variable (Repeat Variable Diresidue (RVD)) and show a strong correlation with specific nucleotide recognition. This simple relationship between amino acid sequence and DNA recognition has allowed for the engineering of specific DNA binding domains by selecting a combination of repeat segments containing the appropriate RVDs.

The non-specific DNA cleavage domain from the end of the Fold endonuclease can be used to construct hybrid nucleases that are active in a yeast assay. These reagents are also active in plant cells and in animal cells. Initial TALEN studies used the wild-type FokI cleavage domain, but some subsequent TALEN studies also used FokI cleavage domain variants with mutations designed to improve cleavage specificity and cleavage activity. The FokI domain functions as a dimer, requiring two constructs with unique DNA binding domains for sites in the target genome with proper orientation and spacing. Both the number of amino acid residues between the TALEN DNA binding domain and the FokI cleavage domain and the number of bases between the two individual TALEN binding sites are parameters for achieving high levels of activity. The number of amino acid residues between the TALEN DNA binding domain and the FokI cleavage domain may be modified by introduction of a spacer (distinct from the spacer sequence) between the plurality of TAL effector repeat sequences and the FokI endonuclease domain. The spacer sequence may be 12 to 30 nucleotides.

The relationship between amino acid sequence and DNA recognition of the TALEN binding domain allows for designable proteins. In this case artificial gene synthesis is problematic because of improper annealing of the repetitive sequence found in the TALE binding domain. One solution to this is to use a publicly available software program (DNAWorks) to calculate oligonucleotides suitable for assembly in a two step PCR; oligonucleotide assembly followed by whole gene amplification. A number of modular assembly schemes for generating engineered TALE constructs have also been reported. Both methods offer a systematic approach to engineering DNA binding domains that is conceptually similar to the modular assembly method for generating zinc finger DNA recognition domains.

Once the TALEN genes have been assembled they are inserted into plasmids; the plasmids are then used to transfect the target cell where the gene products are expressed and enter the nucleus to access the genome. TALENs can be used to edit genomes by inducing double-strand breaks (DSB), which cells respond to with repair mechanisms. In this manner, they can be used to correct mutations in the genome which, for example, cause disease.

As used herein, a "zinc finger polypeptide" or "zinc finger protein" is a protein that binds to DNA, RNA and/or protein, in a sequence-specific manner, by virtue of a metal stabilized domain known as a zinc finger. Zinc finger proteins are nucleases having a DNA cleavage domain and a DNA binding zinc finger domain Zinc finger polypeptides may be made by fusing the nonspecific DNA. cleavage domain of an endonuclease with site-specific DNA binding zinc finger domains. Such nucleases are powerful tools for gene editing and can be assembled to induce double strand breaks (DSBs) site-specifically into genomic DNA. ZFNs allow specific gene disruption as during DNA repair, the targeted genes can be disrupted via mutagenic non-homologous end joint (NHEJ) or modified via homologous recombination (HR) if a closely related DNA template is supplied.

Zinc finger nucleases are chimeric enzymes made by fusing the nonspecific DNA. cleavage domain of the endonuclease FokI with site-specific DNA binding zinc finger domains. Due to the flexible nature of zinc finger proteins (ZFPs), ZFNs can be assembled that induce double strand breaks (DSBs) site-specifically into genomic DNA. ZFNs allow specific gene disruption as during DNA repair, the targeted genes can be disrupted via mutagenic non-homologous end joint (NHEJ) or modified via homologous recombination (HR) if a closely related DNA template is supplied.

In some embodiments, a suitable physical blocker for use in the agent, compositions, and methods of the invention comprises a gRNA, antisense DNA, or triplex forming oligonucleotide (which may target an expression control unit) steric block a transcriptional control element or anchoring sequence. The gRNA recognizes specific DNA sequences and further includes sequences that interfere with, e.g., a conjunction nucleating molecule sequence to act as a steric blocker. In some embodiments, the gRNA is combined with one or more peptides, e.g., S-adenosyl methionine (SAM), that acts as a steric presence. In other embodiments, a physical blocker comprises an enzymatically inactive Cas9 polypeptide, or fragment thereof (e.g., dCas9).

In one embodiment, an epigenetic recruiter activates or enhances transcription of a target gene. In some embodiments, a suitable epigenetic recruiter for use in the agent, compositions, and methods of the invention comprises a VP64 domain or a p300 core domain.

In one embodiment, an epigenetic recruiter silences or represses transcription of a target gene. In some embodiments, a suitable epigenetic recruiter for use in the agent, compositions, and methods of the invention comprises a KRAB domain, or an MeCP2 domain.

In one embodiment, a suitable epigenetic recruiter for use in the agent, compositions, and methods of the invention comprises dCas9-VP64 fusion, a dCas9-p300 core fusion, a dCas9-KRAB fusion, or a dCas9-KRAB-MeCP2 fusion.

As used herein, "VP64" is a transcriptional activator composed of four tandem copies of VP16 (Herpes Simplex Viral Protein 16, amino acids 437-447*: DALDDFDLDML (SEQ ID NO: 328)) connected with glycine-serine (GS) linkers. In one embodiment, the VP64 further comprises the transcription factors p65 (RelA) and Rta at the C terminus. An effector that comprises VP64, p65 and Rta is referred to as "VPR." The GenBank Accession number of VP64 is ADD60007.1, the GenBank Accession number of p65 is NP_001138610.1, and the GenBank Accession number of Rta is AAA66528.1.

An exemplary amino acid sequence of a VPR is as follows:

```
                                            (SEQ ID NO.: 66)
DALDDFDLDMLGSDALDDFDLDMLGSDALDDFDLDMLGSDALDDFDLDML

SGGGPKKKRKVGSQYLPDTDDRHRIEEKRKRTYETFKSIMKKSPFSGPTDP

RPPPRRIAVPSRSSASVPKPAPQPYPFTSSLSTINYDEFPTMVFPSGQIS

QASALAPAPPQVLPQAPAPAPAPAMVSALAQAPAPVPVLAPGPPQAVAPP

APKPTQAGEGTLSEALLQLQFDDEDLGALLGNSTDPAVFTDLASVDNSEF

QQLLNQGIPVAPHTTEPMLMEYPEAITRLVTGAQRPPDPAPAPLGAPGLP

NGLLSGDEDFSSIADMDFSALLGSGSGSRDSREGMFLPKPEAGSAISDVF

EGREVCQPKRLRPFHPPGSPWANRPLPASLAPTPTGPVHEPVGSLTPAPV

PQPLDPAPAVTPEASHLLEDPDEETSQAVKALREMADTVIPQKEEAAICG

QMDLSHPPPRGHLDELTTTLESMTEDLNLDSPLTPELNEILDTFLNDECL

LHAMHISTGLSIFDTSLF
```

As used herein, "p300 core domain" refers to the catalytic core of the human acetyltransferase p300. The GenBank Accession number for the protein comprising p300 is NP_001420.2.

An exemplary amino acid sequence of a p300 is as follows:

```
                                            (SEQ ID NO.: 67)
IFKPEELRQALMPTLEALYRQDPESLPFRQPVDPQLLGIPDYEDIVKSPM

DLSTIKRKLDTGQYQEPWQYVDDIWLMFNNAWLYNRKTSRVYKYCSKLSE
```

-continued

VFEQEIDPVMQSLGYCCGRKLEFSPQTLCCYGKQLCTIPRDATYYSYQNR

YHFCEKCFNEIQGESVSLGDDPSQPQTTINKEQFSKRKNDTLDPELFVEC

TECGRKMHQICVLHHEIIWPAGFVCDGCLKKSARTRKENKFSAKRLPSTR

LGTFLENRVNDFLRRQNHPESGEVTVRVVHASDKTVEVKPGMKARFVDSG

EMAESFPYRTKALFAFEEIDGVDLCFFGMHVQEYGSDCPPPNQRRVYISY

LDSVHFFRPKCLRTAVYHEILIGYLEYVKKLGYTTGHIWACPPSEGDDYI

FHCHPPDQKIPKPKRLQEWYKKMLDKAVSERIVHDYKDIFKQATEDRLTS

AKELPYFEGDFWPNVLEESIKELEQEEEERKREENTSNESTDVTKGDSKN

AKKKNNKKTSKNKSSLSRGNKKKPGMPNVSNDLSQKLYATMEKHKEVFFV

IRLIAGPAANSLPPIVDPDPLIPCDLMDGRDAFLTLARDKHLEFSSLRRA

QWSTMCMLVELHTQSQD.

As used herein, "KRAB" refers to a Krüppel associated box (KRAB) transcriptional repression domain present in human zinc finger protein-based transcription factors (KRAB zinc finger proteins).

As used herein, MeCp2" refers to methyl CpG binding protein 2 which represses transcription, e.g., by binding to a promoter comprising methylated DNA.

In one embodiment, an epigenetic CpG modifier methylates DNA and inactivates or represses transcription. In some embodiments, a suitable epigenetic CpG modifier for use in the agent, compositions, and methods of the invention comprises a MQ1 domain or a DNMT3a-3L domain.

In one embodiment, an epigenetic CpG modifier demethylates DNA and activates or stimulates transcription. In some embodiments, a suitable epigenetic recruiter for use in the agent, compositions, and methods of the invention comprises a TET1 or TET2 domain.

As used herein "TET1" refers to "ten-eleven translocation methylcytosine dioxygenase 1," a member of the TET family of enzymes, encoded by the TET1 gene. TET1 is a dioxygenase that catalyzes the conversion of the modified DNA base 5-methylcytosine (5-mC) to 5-hydroxymethylcytosine (5-hmC) by oxidation of 5-mC in an iron and alpha-ketoglutarate dependent manner, the initial step of active DNA demethylation in mammals Methylation at the C5 position of cytosine bases is an epigenetic modification of the mammalian genome which plays an important role in transcriptional regulation. In addition to its role in DNA demethylation, plays a more general role in chromatin regulation. Preferentially binds to CpG-rich sequences at promoters of both transcriptionally active and Polycomb-repressed genes. Involved in the recruitment of the O-GlcNAc transferase OGT to CpG-rich transcription start sites of active genes, thereby promoting histone H2B GlcNAcylation by OGT.

As used herein, "TET2" refers to "ten-eleven translocation 2 (TET2)," a member of the TET family of enzymes, encoded by the TET1 gene. Similarly to TET1, TET2 is a dioxygenase that catalyzes the conversion of the modified genomic base 5-methylcytosine (5mC) into 5-hydroxymethylcytosine (5hmC) and plays a key role in active DNA demethylation. TET2 a preference for 5-hydroxymethylcytosine in CpG motifs. TET2 also mediates subsequent conversion of 5hmC into 5-formylcytosine (5fC), and conversion of 5fC to 5-carboxylcytosine (5caC). The conversion of 5mC into 5hmC, 5fC and 5caC probably constitutes the first step in cytosine demethylation. Methylation at the C5 position of cytosine bases is an epigenetic modification of the mammalian genome which plays an important role in transcriptional regulation. In addition to its role in DNA demethylation, also involved in the recruitment of the O-GlcNAc transferase OGT to CpG-rich transcription start sites of active genes, thereby promoting histone H2B GlcNAcylation by OGT.

As used herein "DNMT3a-3L" refers to a fusion of a DNA methyltransferase, Dnmt3a and a Dnmt3L which is catalytically inactive, but directly interacts with the catalytic domains of Dnmt3a.

In some embodiments, a suitable epigenetic recruiter for use in the agent, compositions, and methods of the invention comprises a MQ1 domain, a DNMT3a-3L domain, a TET1 domain, or a TET2 domain. In one embodiment, a suitable epigenetic recruiter for use in the agent, compositions, and methods of the invention comprises a dCas9-MQ1 fusion, a dCas9-DNMT3a-3L fusion, a dCas9-TET1 fusion or a dCAS9-TET2 fusion.

III. Delivery of a Site-Specific HNF4α Disrupting Agent of the Invention and Compositions Comprising a Site-Specific an HNF4α Disrupting Agents of the Invention The delivery of the disrupting agents of the invention to a cell e.g., a cell within a subject, such as a human subject (e.g., a subject in need thereof, such as a subject having an HNF4α-associated disorder, e.g., cirrhosis) may be achieved in a number of different ways. For example, delivery may be performed by contacting a cell with a disrupting agent of the invention either in vitro, ex vivo, or in vivo. In vivo delivery may be performed directly by administering a composition, such as a lipid composition, comprising a disrupting agent to a subject. Alternatively, in vivo delivery may be performed indirectly by administering one or more vectors that encode and direct the expression of the disrupting agent. These alternatives are discussed further below.

In some embodiments, the disrupting agent comprises a nucleic acid molecule encoding a fusion protein, the fusion protein comprising a site-specific HNF4α targeting moiety, such as a polynucleotide encoding a DNA-binding domain of a Transcription activator-like effector (TALE) polypeptide or a zinc finger (ZNF) polypeptide, or fragment thereof, that specifically targets and binds to the HNF4α expression control region and an effector molecule, such as a VPR.

In other embodiments, the disrupting agent comprises a guide RNA and an mRNA encoding an effector molecule. The ratio of guide RNA to mRNA may be about 100:1 to about 1:100 (wt:wt).

In general, any method of delivery of a site-specific HNF4α disrupting agent of the invention (in vitro, ex vivo, or in vivo) may be adapted for use with the disrupting agents of the invention (see e.g., Akhtar S. and Julian R L., (1992) *Trends Cell. Biol.* 2(5):139-144 and WO94/02595, which are incorporated herein by reference in their entireties). For in vivo delivery, factors to be considered for delivering a site-specific HNF4α disrupting agent of the invention include, for example, biological stability of the disrupting agent, prevention of non-specific effects, and accumulation of the disrupting agent in the target tissue. The non-specific effects of a disrupting agent can be minimized by local administration, for example, by direct injection or implantation into a tissue or topically administering a composition comprising the disrupting agent. Local administration to a treatment site maximizes local concentration of the disrupting agent, limits the exposure of the disrupting agent to systemic tissues that can otherwise be harmed by the disrupting agent or that can degrade the disrupting agent, and permits a lower total dose of the disrupting agent to be administered.

For administering a site-specific HNF4α disrupting agent systemically for the treatment of a disease, such as an HNF4α-associate disease, the disrupting agent, e.g., a disrupting agent comprising a site-specific targeting moiety comprising a nucleic acid molecule, can be modified or alternatively delivered using a drug delivery system; both methods act to prevent the rapid degradation of a site-specific targeting moiety comprising a nucleic acid molecule by endo- and exo-nucleases in vivo. Modification of a disrupting agent comprising a site-specific targeting moiety comprising a nucleic acid molecule or a pharmaceutical carrier also permits targeting of the disrupting agent to a target tissue and avoidance of undesirable off-target effects. For example, a disrupting agent of the invention may be modified by chemical conjugation to lipophilic groups such as cholesterol to enhance cellular uptake and prevent degradation.

Alternatively, a disrupting agent of the invention may be delivered using a drug delivery system such as a nanoparticle, a dendrimer, a polymer, a liposome, or a cationic delivery system. Positively charged cationic delivery systems facilitate binding of disrupting agent (e.g., negatively charged molecule) and also enhance interactions at the negatively charged cell membrane to permit efficient uptake of a disrupting agent by the cell. Cationic lipids, dendrimers, or polymers can either be bound to a disrupting agent, or induced to form a vesicle or micelle (see e.g., Kim S H. et al., (2008) *Journal of Controlled Release* 129(2):107-116) that encases the disrupting agent. The formation of vesicles or micelles further prevents degradation of the disrupting agent when administered systemically. Methods for making and administering cationic complexes are well within the abilities of one skilled in the art (see e.g., Sorensen, D R., et al. (2003) *J. Mol. Biol* 327:761-766; Verma, U N. et al., (2003) *Clin. Cancer Res.* 9:1291-1300; Arnold, A S et al. (2007) *J. Hypertens.* 25:197-205, which are incorporated herein by reference in their entirety). Some non-limiting examples of drug delivery systems useful for systemic delivery of a disrupting agent of the invention include DOTAP (Sorensen, D R., et al (2003), supra; Verma, U N. et al., (2003), supra), Oligofectamine, "solid nucleic acid lipid particles" (Zimmermann, T S. et al., (2006) *Nature* 441:111-114), cardiolipin (Chien, P Y. et al., (2005) *Cancer Gene Ther.* 12:321-328; Pal, A. et al., (2005) *Int J. Oncol.* 26:1087-1091), polyethyleneimine (Bonnet M E. et al., (2008) *Pharm. Res.* August 16 Epub ahead of print; Aigner, A. (2006) *J. Biomed. Biotechnol.* 71659), Arg-Gly-Asp (RGD) peptides (Liu, S. (2006) *Mol. Pharm.* 3:472-487), and polyamidoamines (Tomalia, D A. et al., (2007) *Biochem. Soc. Trans.* 35:61-67; Yoo, H. et al., (1999) *Pharm. Res.* 16:1799-1804). In some embodiments, a disrupting agent (e.g., gRNA, or mRNA) forms a complex with cyclodextrin for systemic administration. Methods for administration and pharmaceutical compositions comprising cyclodextrins may be found in U.S. Pat. No. 7,427,605, the entire contents of which are incorporated herein by reference.

The disrupting agents of the invention may be incorporated into pharmaceutical compositions suitable for administration. Such compositions typically include one or more species of disrupting agent and a pharmaceutically acceptable carrier. As used herein the language "pharmaceutically acceptable carrier" is intended to include any and all solvents, dispersion media, coatings, antibacterial and antifungal agents, isotonic and absorption delaying agents, and the like, compatible with pharmaceutical administration. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

The pharmaceutical compositions of the present invention may be administered in a number of ways depending upon whether local or systemic treatment is desired and upon the area to be treated. Administration may be topical (including ophthalmic, vaginal, rectal, intranasal, transdermal), oral, or parenteral. Parenteral administration includes intravenous drip, subcutaneous, intraperitoneal or intramuscular injection, or intrathecal or intraventricular administration.

The route and site of administration may be chosen to enhance delivery or targeting of the disrupting agent comprising a site-specific targeting moiety to a particular location. For example, to target liver cells, intravenous injection may be used. Lung cells may be targeted by administering the disrupting agent in aerosol form. Jejunum cells may be targeted by anal administration.

Formulations for topical administration may include transdermal patches, ointments, lotions, creams, gels, drops, suppositories, sprays, liquids, and powders. Conventional pharmaceutical carriers, aqueous, powder or oily bases, thickeners and the like may be necessary or desirable. Coated condoms, gloves and the like may also be useful.

Compositions for oral administration include powders or granules, suspensions or solutions in water, syrups, elixirs or non-aqueous media, tablets, capsules, lozenges, or troches. In the case of tablets, carriers that can be used include lactose, sodium citrate and salts of phosphoric acid. Various disintegrants such as starch, and lubricating agents such as magnesium stearate, sodium lauryl sulfate and talc, are commonly used in tablets. For oral administration in capsule form, useful diluents are lactose and high molecular weight polyethylene glycols. When aqueous suspensions are required for oral use, the nucleic acid compositions can be combined with emulsifying and suspending agents. If desired, certain sweetening or flavoring agents can be added.

Compositions for intravenous administration may include sterile aqueous solutions which may also contain buffers, diluents, and other suitable additives.

Formulations for parenteral administration may include sterile aqueous solutions which may also contain buffers, diluents, and other suitable additives. For intravenous use, the total concentration of solutes may be controlled to render the preparation isotonic.

In one embodiment, the administration of a disrupting agent composition of the invention is parenteral, e.g., intravenous (e.g., as a bolus or as a diffusible infusion), intradermal, intraperitoneal, intramuscular, intrathecal, intraventricular, intracranial, subcutaneous, transmucosal, buccal, sublingual, endoscopic, rectal, oral, vaginal, topical, pulmonary, intranasal, urethral, or ocular. Administration can be provided by the subject or by another person, e.g., a health care provider. The composition may be provided in measured doses or in a dispenser which delivers a metered dose. Selected modes of delivery are discussed in more detail below.

In certain embodiments, the disrupting agents of the invention are polynucleotides, such as mRNAs, and are formulated in lipid nanoparticles (LNPs).

A. Compositions Comprising a Site-Specific an HNF4α Disrupting Agent of the Invention The site-specific HNF4α disrupting agents of the invention may be formulated into compositions, such as pharmaceutical compositions, using one or more excipients to: (1) increase stability; (2) increase cell transfection; (3) permit sustained or delayed release (e.g., from a depot formulation); (4) alter the biodistribution (e.g., target the disrupting agent to specific tissues or cell types); (5) increase the translation of an encoded protein in vivo; and/or (6) alter the release profile of an encoded protein in vivo. In addition to traditional excipients, such as any and all solvents, dispersion media, diluents, or other liquid vehicles, dispersion or suspension aids, surface active agents, isotonic agents, thickening or emulsifying agents, preservatives, excipients for use in the compositions of the invention may include, without limitation, lipidoids, liposomes, lipid nanoparticles, polymers, lipoplexes, core-shell nanoparticles, peptides, proteins, cells transfected with nucleic acid molecules, modified nucleic acid molecules, or RNA (e.g., for transplantation into a subject), hyaluronidase, nanoparticle mimics and combinations thereof. Accordingly, the pharmaceutical compositions of the invention can include one or more excipients, each in an amount that together increases the stability of the disrupting agent, increases cell transfection by the disrupting agent, increases the expression of modified nucleic acid, or mRNA encoded protein, and/or alters the release profile of a disrupting agent. Further, the disrupting agents of the present invention may be formulated using self-assembled nucleic acid nanoparticles (see, e.g., U.S. Patent Publication No. 2016/0038612A1, which is incorporated herein by reference in its entirety).

i. Lipidoid

The synthesis of lipidoids has been extensively described and formulations containing these compounds are particularly suited for delivery of a disrupting agent of the invention, such as a disrupting agent comprising a site-specific HNF4α targeting moiety comprising a nucleic acid molecule, e.g., comprising modified nucleic acid molecules or mRNA (see Mahon et al., Bioconjug Chem. 2010 21:1448-1454; Schroeder et al., J Intern Med. 2010 267:9-21; Akinc et al., Nat Biotechnol. 2008 26:561-569; Love et al., Proc Natl Acad Sci USA. 2010 107: 1864-1869; Siegwart et al., Proc Natl Acad Sci USA. 2011108:12996-3001; the contents of all of which are incorporated herein in their entireties).

For example, lipidoids have been used to effectively deliver double stranded small interfering RNA molecules, single stranded nucleic acid molecules, modified nucleic acid molecules or modified mRNA. (See, e.g., US Patent Publication 2016/0038612A1). Complexes, micelles, liposomes or particles can be prepared containing these lipidoids and, therefore, provide effective delivery of a site-specific HNF4α targeting moiety comprising a nucleic acid molecule, as judged by the production of an encoded protein, following the administration of a lipidoid formulation, e.g., via localized and/or systemic administration. Lipidoid complexes of can be administered by various means including, but not limited to, intravenous, intramuscular, intradermal, intraperitoneal or subcutaneous routes.

In vivo delivery of a site-specific HNF4α targeting moiety comprising, e.g., a nucleic acid molecule, may be affected by many parameters, including, but not limited to, the formulation composition, nature of particle PEGylation, degree of loading, polynucleotide to lipid ratio, and biophysical parameters such as, but not limited to, particle size (Akinc et al., Mol Ther. 2009 17:872-879; herein incorporated by reference in its entirety). As an example, small changes in the anchor chain length of poly(ethylene glycol) (PEG) lipids may result in significant effects on in vivo efficacy. Formulations with different lipidoids, including, but not limited to penta[3-(1-laury laminopropiony I)]-triethy lenetetramine hydrochloride (TETA-5LAP; aka 98NI2-5, see Murugaiah et al., Analytical Biochemistry, 401:61 (2010); the contents of which are herein incorporated by reference in their entirety), C12-200 (including derivatives and variants), and MD1, may be used.

In one embodiment, a disrupting agent comprising a site-specific HNF4α targeting moiety comprising, e.g., a nucleic acid molecule, is formulated with a lipidoid for systemic intravenous administration to target cells of the liver. For example, a final optimized intravenous formulation comprising a disrupting agent comprising a site-specific HNF4α targeting moiety comprising a nucleic acid molecule, and a lipid molar composition of 42% 98NI2-5, 48% cholesterol, and 10% PEG-lipid with a final weight ratio of about 7.5 to 1 total lipid to nucleic acid molecule, and a C14 alkyl chain length on the PEG lipid, with a mean particle size of roughly 50-60 nm, can result in the distribution of the formulation to be greater than 90% to the liver (see, Akinc et al., Mol Ther. 2009 17:872-879; the contents of which is herein incorporated by reference in its entirety). In another example, an intravenous formulation using a C12-200 lipidoid (see, e.g., PCT Publication No. WO 2010/129709, which is herein incorporated by reference in its entirety) having a molar ratio of 50/10/38.5/1.5 of C12-200/disteroylphosphatidyl choline/cholesterol/PEG-DMG, with a weight ratio of 7 to 1 total lipid to nucleic acid molecule, and a mean particle size of 80 nm may be used to deliver a disrupting agent comprising a site-specific HNF4α targeting moiety comprising a nucleic acid molecule, to hepatocytes (see, Love et al., Proc Natl Acad Sci USA. 2010 107:1864-1869; the contents of which are herein incorporated by reference in their entirety). In another embodiment, an MD1 lipidoid-containing formulation may be used to effectively deliver a disrupting agent comprising a site-specific HNF4α targeting moiety comprising a nucleic acid molecule, to hepatocytes in vivo. The characteristics of optimized lipidoid formulations for intramuscular or subcutaneous routes may vary significantly depending on the target cell type and the ability of formulations to diffuse through the extracellular matrix into the blood stream. While a particle size of less than 150 nm may be desired for effective hepatocyte delivery due to the size of the endothelial fenestrae (see, Akinc et al., Mol Ther. 2009 17:872-879; the contents of which are herein incorporated by reference in their entirety), use of lipidoid-formulated nucleic acid molecules to deliver the formulation to other cells types including, but not limited to, endothelial cells, myeloid cells, and muscle cells may not be similarly size-limited. Use of lipidoid formulations to deliver siRNA in vivo to other non-hepatocyte cells such as myeloid cells and endothelium has been reported (see Akinc et al., Nat Biotechnol. 200826:561-569; Leuschner et al., Nat Biotechnol. 2011 29: 1005-101 0; Cho et al. Adv. Funct. Mater. 2009 19:3112-3118; 8th International Judah Folkman Conference, Cambridge, Mass. Oct. 8-9, 2010; the contents of each of which are herein incorporated by reference in their entirety). For delivery to myeloid cells, such as monocytes, lipidoid formulations may have a similar component molar ratio. Different ratios of lipidoids and other components including, but not limited to, disteroylphosphatidyl choline, cholesterol and PEG-DMG, may be used to optimize the formulation for delivery to different cell types including, but not limited to, hepatocytes, myeloid cells, muscle cells, etc. For example, the component molar ratio may include, but is not limited to, 50% CI2-200, 10% disteroylphosphatidyl choline, 38.5% cholesterol, and 1.5%

PEG-DMG (see Leuschner et al., Nat Biotechnol 2011 29: 1005-101 0; the contents of which are herein incorporated by reference in its entirety). The use of lipidoid formulations for the localized delivery to cells (such as, but not limited to, adipose cells and muscle cells) via either subcutaneous, intradermal or intramuscular delivery, may not require all of the formulation components desired for systemic delivery and, as such, may comprise only the lipidoid and a disrupting agent comprising comprising a site-specific HNF4α targeting moiety comprising, e.g., a nucleic acid molecule, as described herein.

Combinations of different lipidoids may be used to improve the efficacy of the formulations by increasing cell transfection and/or increasing the translation of encoded protein contained therein (see Whitehead et al., Mol. Ther. 2011, 19:1688-1694, the contents of which are herein incorporated by reference in their entirety).

In one embodiment, the lipidoid may be prepared from the conjugate addition of alkylamines to acrylates. As a non-limiting example, a lipidoid may be prepared by the methods described in PCT Patent Publication No. WO 2014/028487, the contents of which are herein incorporated by reference in its entirety. In one embodiment, the lipidoid may comprise a compound having formula (I), formula (II), formula (III), formula (IV) or formula (V) as described in PCT Patent Publication No. WO 2014/028487, the contents of which are herein incorporated by reference in their entirety. In one embodiment, the lipidoid may be biodegradable.

ii. Liposomes, Lipoplexes, and Lipid Nanoparticles

A disrupting agent of the invention may be formulated using one or more liposomes, lipoplexes, or lipid nanoparticles. In one embodiment, pharmaceutical compositions of the invention include liposomes. Liposomes are artificially-prepared vesicles which are primarily composed of a lipid bilayer and may be used as a delivery vehicle for the administration of nutrients and pharmaceutical formulations. Liposomes may be of different sizes such as, but not limited to, a multilamellar vesicle (MLV) which may be hundreds of nanometers in diameter and may contain a series of concentric bilayers separated by narrow aqueous compartments, a small unicellular vesicle (SUV) which may be smaller than 50 nm in diameter, and a large unilamellar vesicle (LUV) which may be between 50 and 500 nm in diameter. Liposome design may include, but is not limited to, opsonins or ligands in order to improve the attachment of liposomes to unhealthy tissue or to activate events such as, but not limited to, endocytosis. Liposomes may contain a low or a high pH in order to improve the delivery of the pharmaceutical formulations. The formation of liposomes may depend on the physicochemical characteristics such as, but not limited to, the pharmaceutical formulation entrapped and the liposomal ingredients, the nature of the medium in which the lipid vesicles are dispersed, the effective concentration of the entrapped substance and its potential toxicity, any additional processes involved during the application and/or delivery of the vesicles, the optimization size, polydispersity and the shelf-life of the vesicles for the intended application, and the batch-to-batch reproducibility and possibility of large-scale production of safe and efficient liposomal products.

As a non-limiting example, liposomes, such as synthetic membrane vesicles, may be prepared by the methods, apparatus and devices described in U.S. Patent Publication Nos. 2013/0177638, 2013/0177637, 2013/0177636, 201/30177635, 2013/0177634, 2013/0177633, 2013/0183375, 2013/0183373, 2013/0183372 and 2016/0038612) and PCT Patent Publication No WO 2008/042973, the contents of each of which are herein incorporated by reference in their entirety.

In one embodiment, a pharmaceutical composition described herein may include, without limitation, liposomes such as those formed from 1,2-dioleyloxy-N,N-dimethyl ami-nopropane (DODMA) liposomes, DiLa2 liposomes from Marina Biotech (Bothell, Wash.), 1,2-dilinoleyloxy-3-dimethylaminopropane (DLin-DMA), 2,2-dilinoleyl-4-(2-dimethylaminoethyl)-[1,3]-dioxolane (DLin-KC2-DMA), and MC3 (US20100324120; herein incorporated by reference in its entirety) and liposomes which may deliver small molecule drugs such as, but not limited to, DOXIL® from Janssen Biotech, Inc. (Horsham, Pa.). In one embodiment, a pharmaceutical composition described herein may include, without limitation, liposomes such as those formed from the synthesis of stabilized plasmid-lipid particles (SPLP) or stabilized nucleic acid lipid particle (SNALP) that have been previously described and shown to be suitable for oligonucleotide delivery in vitro and in vivo (see Wheeler et al. Gene Therapy. 1999 6:271-281; Zhang et al. Gene Therapy. 19996:1438-1447; Jeffs et al. Pharm Res. 2005 22:362-372; Morrissey et al., Nat Biotechnol. 2005 2:1002-1007; Zimmermann et al., Nature. 2006 441:111-114; Heyes et al. J Contr Rel. 2005 107:276-287; Semple et al. Nature Biotech. 2010 28:172-176; Judge et al. J Clin Invest. 2009 119:661-673; deFougerolles Hum Gene Ther. 2008 19:125-132; U.S. Patent Publication Nos 2013/0122104, 2013/0303587, and 2016/0038612; the contents of each of which are incorporated herein in their entireties). The original manufacturing method of Wheeler et al. was a detergent dialysis method, which was later improved by Jeffs et al. and is referred to as the spontaneous vesicle formation method. The liposome formulations of the invention may be composed of 3 to 4 lipid components in addition a disrupting agent comprising a site-specific HNF4α targeting moiety. As an example a liposome of the invention can contain, but is not limited to, 55% cholesterol, 20% disteroylphosphatidyl choline (DSPC), 10% PEG-SDSG, and 15% 1,2-dioleyloxy-N,N-dimethylaminopropane (DODMA), as described by Jeffs et al. As another example, liposome formulations of the invention may contain, but are not limited to, 48% cholesterol, 20% DSPC, 2% PEG-c-DMA, and 30% cationic lipid, where the cationic lipid can be 1,2-distearloxy-N,N-dimethylaminopropane (DSDMA), DODMA, DLin-DMA, or 1,2-dilinolenyloxy-3-dimethy laminopropane (DLenDMA), as described by Heyes et al. In some embodiments, liposome formulations may comprise from about 25.0% cholesterol to about 40.0% cholesterol, from about 30.0% cholesterol to about 45.0% cholesterol, from about 35.0% cholesterol to about 50.0% cholesterol and/or from about 48.5% cholesterol to about 60% cholesterol. In another embodiment, formulations of the invention may comprise a percentage of cholesterol selected from the group consisting of 28.5%, 31.5%, 33.5%, 36.5%, 37.0%, 38.5%, 39.0% and 43.5%. In some embodiments, liposome formulations of the invention may comprise from about 5.0% to about 10.0% DSPC and/or from about 7.0% to about 15.0% DSPC.

In one embodiment, a pharmaceutical composition may include liposomes which may be formed to deliver a disrupting agent of the invention. The disrupting agent comprising a site-specific HNF4α targeting moiety comprising may be encapsulated by the liposome and/or it may be contained in an aqueous core which may then be encapsulated by the liposome (see, e.g., PCT Patent Publication Nos. WO 2012/031046, WO 2012/031043, WO 2012/030901 and WO 2012/006378 and U.S. Patent Publication Nos. 2013/

0189351, 2013/0195969 and 201/30202684, the contents of each of which are herein incorporated by reference in their entirety).

In another embodiment, liposomes for use in the present invention may be formulated for targeted delivery. As a non-limiting example, the liposome may be formulated for targeted delivery to the liver. Such a liposome may include, but is not limited to, a liposome described in U.S. Patent Publication No. 2013/0195967, the contents of which are herein incorporated by reference in their entirety.

In one embodiment, formulations comprising liposomes and a disrupting agent may be administered intramuscularly, intradermally, or intravenously.

In another embodiment, a lipid formulation of the invention may include at least one cationic lipid, a lipid which enhances transfection and a least one lipid which contains a hydrophilic head group linked to a lipid moiety (International Pub. No. WO2011076807 and U.S. Pub. No. 20110200582; the contents of each of which is herein incorporated by reference in their entirety). In another embodiment, a lipid formulation of the invention is a lipid vesicle which may have crosslinks between functionalized lipid bilayers (see U.S. Patent Publication No. 2012/0177724, the contents of which are herein incorporated by reference in their entirety).

In one embodiment, a formulation comprising a disrupting agent is a lipid nanoparticle (LNP) which may comprise at least one lipid. The lipid may be selected from, but is not limited to, DLin-DMA, DLin-K-DMA, 98NI2-5, CI2-200, DLin-MC3-DMA, DLin-KC2-DMA, DODMA, PLGA, PEG, PEG-DMG, PEGylated lipids and amino alcohol lipids. In another aspect, the lipid may be a cationic lipid such as, but not limited to, DLin-DMA, DLin-D-DMA, DLin-MC3-DMA, DLin-KC2-DMA, DODMA and amino alcohol lipids. The amino alcohol cationic lipid may be the lipids described in and/or made by the methods described in U.S. Patent Publication No. 2013/0150625.

In one embodiment, the cationic lipid may be selected from, but not limited to, a cationic lipid described in PCT Publication Nos. WO 2012/040184, WO 2011/153120, WO 2011/149733, WO 2011/090965, WO 2011/043913, WO 2011/022460, WO 2012/061259, WO 2012/054365, WO 2012/044638, WO 2010/080724, WO 2010/21865, WO 2008/103276, WO 2013/086373 and WO 2013/086354, U.S. Pat. Nos. 7,893,302, 7,404,969, 8,283, 333, 8,466,122 and 8,569,256, and U.S. Patent Publication Nos. 2010/0036115, 2012/0202871, 2013/0064894, 2013/0129785, 2013/0150625, 2013/0178541, 2013/0225836 and 2014/0039032; the contents of each of which are herein incorporated by reference in their entirety. In another embodiment, the cationic lipid may be selected from, but not limited to, formula A described in PCT Publication Nos. WO 2012/040184, WO 0111/53120, WO 2011/149733, WO 2011/090965, WO 2011/043913, WO 2011/022460, WO 2012/061259, WO 2012/054365, WO 2012/044638 and WO 2013/116126 or U.S. Patent Publication Nos. 2013/0178541 and 2013/0225836; the contents of each of which is herein incorporated by reference in their entirety. In yet another embodiment, the cationic lipid may be selected from, but not limited to, formula CLI-CLXXIX of PCT Publication No. WO 2008/103276, formula CLICLXXIX of U.S. Pat. No. 7,893,302, formula CLICLXXXII of U.S. Pat. No. 7,404,969 and formula I-VI of US Patent Publication No. 2010/0036115, formula I of U.S. Patent Publication No 2013/0123338; each of which is herein incorporated by reference in their entirety.

In one embodiment, the cationic lipid may be synthesized by methods known in the art and/or as described in PCT Publication Nos. WO 2012/040184 WO 2011/153120, WO 2011/149733, WO 2011/090965: WO 2011/043913, WO 2011/022460, WO 2012/061259, WO 2012/054365, WO 2012/044638, WO 2010/080724, WO 2010/21865, WO 2013/126803, WO 2013/086373, and WO 2013/086354; the contents of each of which are herein incorporated by reference in their entirety.

In one embodiment, the lipids which may be used in the formulations and/or for delivery of the disrupting agents described herein may be a cleavable lipid. As a non-limiting example, a cleavable lipid and/or pharmaceutical compositions comprising cleavable lipids include those described in PCT Patent Publication No. WO 2012/170889, the contents of which are herein incorporated by reference in their entirety. As another non-limiting example, the cleavable lipid may be HGT4001, HGT4002, HGT4003, HGT4004 and/or HGT4005 as described in PCT Patent Publication No. WO 2012/170889, the contents of which are herein incorporated by reference in their entirety.

In one embodiment, polymers which may be used in the formulation and/or delivery of the disrupting agents described herein may include, but is not limited to, poly (ethylene) glycol (PEG), polyethylenimine (PEI), dithiobis (succinimidylpropionate) (DSP), Dimethy 1-3,3'-dithiobis-propionimidate (DTBP), poly(ethylene imine) biscarbamate (PEIC), poly(L-lysine) (PLL), histidine modified PLL, poly (N-vinylpyrrohdone) (PVP), poly(propylenimine (PPI), poly(amidoamine) (PAMAM), poly(amido ethylenimine) (SS-PAEI), triehtylenetetramine (TETA), poly(β-aminoester), poly(4-hydroxy-L-proine ester) (PHP), poly(allylamine), poly(α-[4-aminobutyl]-L-glycolic acid (PAGA), Poly(D,L-lactic-coglycolid acid (PLGA), Poly(N-ethyl-4-vinylpyridinium bromide), poly(phosphazene)s (PPZ), poly (phosphoester)s (PPE), poly(phosphoramidate)s (PPA), poly (N-2-hydroxypropylmethacrylamide) (pHPMA), poly(2-(dimethylamino)ethyl methacrylate) (pDMAEMA), poly(2-aminoethyl propylene phosphate) PPE_EA), Chitosan, galactosylated chitosan, N-dodecylated chitosan, histone, collagen and dextran-spermine. In one embodiment, the polymer may be an inert polymer such as, but not limited to, PEG. In one embodiment, the polymer may be a cationic polymer such as, but not limited to, PE1, PLL, TETA, poly(allylamine), Poly(N-ethyl-4-vinylpyridinium bromide), pHPMA and pDMAEMA. In one embodiment, the polymer may be a biodegradable PE1 such as, but not limited to, DSP, DTBP and PEIC. In one embodiment, the polymer may be biodegradable such as, but not limited to, histine modified PLL SSPAEI, poly((3-aminoester), PHP, PAGA, PLGA, PPZ, PPE, PPA and PPE-EA.

In one embodiment, an LNP formulation of the invention may be prepared according to the methods described in PCT Publication Nos. WO 2011/127255 or WO 2008/103276, the contents of each of which are herein incorporated by reference in their entirety. As a non-limiting example, a disrupting agent comprising a site-specific HNF4α targeting moiety may be encapsulated in an LNP formulation as described in PCT Publication Nos. WO 2011/127255 and/or WO 2008/103276; the contents of each of which are herein incorporated by reference in their entirety. As another non-limiting example, a disrupting agent comprising a site-specific HNF4α targeting moiety as described herein, may be formulated in a nanoparticle to be delivered by a parenteral route as described in U.S. Patent Publication No.

2012/0207845 and PCT Publication No. WO 2014/008334; the contents of each of which are herein incorporated by reference in their entirety.

In one embodiment, LNP formulations described herein may be administered intramuscularly. The LNP formulation may comprise a cationic lipid described herein, such as, but not limited to, DLin-DMA, DLin-KC2-DMA, DLin-MC3-DMA, DODMA and C12-200.

In one embodiment, LNP formulations described herein comprising a disrupting agent as described herein, may be administered intradermally. The LNP formulation may comprise a cationic lipid described herein, such as, but not limited to, DLin-DMA, DLin-KC2-DMA, DLin-MC3-DMA, DODMA and C12-200.

The nanoparticle formulations may comprise conjugate, such as a phosphate conjugate, a polymer conjugates, a conjugate that enhances the delivery of nanoparticle as described in US Patent Publication No. US20160038612 A1.

In one embodiment, the lipid nanoparticle formulation comprises DLin-MC3-DMA as described in US Patent Publication No. US20100324120.

In one embodiment, the lipid nanoparticle comprises a lipid compound, or a pharmaceutically acceptable salt, tautomer or stereoisomer thereof, or a lipid nanoparticle formulation, as described in U.S. Pat. No. 10,723,692B2, US Patent Publication Nos. US20200172472A1, US20200163878A1, US20200046838A1, US20190359556A1, US20190314524A1, US20190274968A1, US20190022247A1, US20180303925A1, US20180185516A1, US20160317676A1, International Patent Publication No.: WO20200146805A1, WO2020081938A1, WO2019089828A1, WO2019036030A1, WO2019036028A1, WO2019036008A1, WO 2018200943A1, WO2018191719A1, WO2018107026A1, WO2018081480A1, the contents of each of which are herein incorporated by reference in their entirety (Acuitas Therapeutics, Inc.).

In one embodiment, the lipid nanoparticle comprises an amino lipid, or a pharmaceutically acceptable salt, tautomer or stereoisomer thereof, or a lipid nanoparticle formulation, described by Tekmira Pharmaceuticals Corp. in U.S. Pat. No. 9,139,554B2, U.S. Pat. No. 9,051,567B2, U.S. Pat. No. 8,883,203B2, US Patent Publication US20110117125A1, the contents of each of which are herein incorporated by reference in their entirety. In one particular example, the compound described in U.S. Pat. No. 9,139,554B2 is DLin-kC2-DMA.

In one embodiment, the lipid nanoparticle comprises an amino lipid, or a pharmaceutically acceptable salt, tautomer or stereoisomer thereof, or a lipid nanoparticle formulation, described by Arbutus Biopharma Corp. in U.S. Ser. No. 10/561,732B2, U.S. Pat. No. 9,938,236B2, U.S. Pat. No. 9,687,550B2, US Patent Publication US20190240354A1, US20170027658A1, WO2020097493A1, WO2020097520A1, WO2020097540A1, WO2020097548A1, the contents of each of which are herein incorporated by reference in their entirety.

Lipid nanoparticles may be engineered to alter the surface properties of particles so the lipid nanoparticles may penetrate the mucosal barrier. Mucus is located on mucosal tissue such as, but not limited to, oral (e.g., the buccal and esophageal membranes and tonsil tissue), ophthalmic, gastrointestinal (e.g., stomach, small intestine, large intestine, colon, rectum), nasal, respiratory (e.g., nasal, pharyngeal, tracheal and bronchial membranes), genital (e.g., vaginal, cervical and urethral membranes). Nanoparticles larger than 10-200 nm which are preferred for higher drug encapsulation efficiency and the ability to provide the sustained delivery of a wide array of drugs have been thought to be too large to rapidly diffuse through mucosal barriers. Mucus is continuously secreted, shed, discarded or digested and recycled so most of the trapped particles may be removed from the mucosla tissue within seconds or within a few hours. Large polymeric nanoparticles (200 nm-500 nm in diameter) which have been coated densely with a low molecular weight polyethylene glycol (PEG) diffused through mucus only 4 to 6-fold lower than the same particles diffusing in water (Lai et al. PNAS 2007 104(5): 1482-487; Lai et al. Adv Drug Deliv Rev. 200961(2): 158-171; the contents of each of which are herein incorporated by reference in their entirety). The transport of nanoparticles may be determined using rates of permeation and/or fluorescent microscopy techniques including, but not limited to, fluorescence recovery after photobleaching (FRAP) and high resolution multiple particle tracking (MPT). As a non-limiting example, compositions which can penetrate a mucosal barrier may be made as described in U.S. Pat. No. 8,241,670 or International Patent Publication No. WO2013110028, the contents of each of which are herein incorporated by reference in their entirety.

In one embodiment, a disrupting agent comprising a site-specific HNF4α targeting moiety as described herein, is formulated as a lipoplex, such as, without limitation, the ATUPLEX™ system, the DACC system, the DBTC system and other siRNAlipoplex technology from Silence Therapeutics (London, United Kingdom), STEMFECFM from STEMGENT® (Cambridge, Mass.), and polyethylenimine (PE1) or protamine-based targeted and non-targeted delivery of nucleic acids acids (Aleku et al. Cancer Res. 2008 68:9788-9798; Strumberg et al. Int J Clin Pharmacol Ther 2012 50:76-78; Santel et al., Gene Ther 2006 13:1222-1234; Santel et al., Gene Ther 200613:1360-1370; Gutbier et al., PulmPharmacol. Ther. 201023:334-344; Kaufmann et al. Microvasc Res 2010 80:286-293; Weide et al. J Immunother. 2009 32:498-507; Weide et al. J Immnnother. 2008 31:180-188; Pascolo Expert Opin. Biol. Ther. 4:1285-1294; Fotin-Mleczek et al., 2011 J. Immunother. 34: 1-15; Song et al., Nature Biotechnol. 2005, 23:709-717; Peer et al., Proc Natl Acad Sci USA. 2007 6; 104:4095-4100; deFougerolles *Hum Gene Ther.* 2008 19: 125-132; all of which are incorporated herein by reference in their entirety).

In one embodiment such formulations may also be constructed or compositions altered such that they passively or actively are directed to different cell types in vivo, including but not limited to hepatocytes, immune cells, tumor cells, endothelial cells, antigen presenting cells, and leukocytes (Akinc et al. Mol Ther. 2010 18:1357-1364; Song et al., Nat Biotechnol. 2005 23:709-717; Judge et al., J Clin Invest. 2009 119:661-673; Kaufmann et al., Microvasc Res 2010 80:286-293; Santel et al., Gene Ther 200613:1222-1234; Santel et al., Gene Ther 2006 13: 1360-1370; Gutbier et al., Pulm Pharmacol. Ther. 2010 23:334-344; Basha et al., Mol. Ther. 2011 19:2186-2200; Fenske and Cullis, Expert Opin Drug Deliv. 20085:25-44; Peer et al., Science. 2008 319: 627-630; Peer and Lieberman, Gene Ther. 2011 18: 1127-1133; all of which are incorporated herein by reference in its entirety). One example of passive targeting of formulations to liver cells includes the DLin-DMA, DLin-KC2-DMA and DLin-MC3-DMA-based lipid nanoparticle formulations which have been shown to bind to apolipoprotein E and promote binding and uptake of these formulations into hepatocytes in vivo (Akinc et al. Mol Ther. 2010 18:

1357-1364; the contents of which are herein incorporated by reference in its entirety). Formulations can also be selectively targeted through expression of different ligands on their surface as exemplified by, but not limited to, folate, transferrin, N-acetylgalactosamine (GalNAc), and antibody targeted approaches (Kolhatkar et al., Curr Drug Discov Technol. 2011 8: 197-206; Musacchio and Torchilin, Front Biosci. 201116: 1388-1412; Yu et al., Mol Membr Biol. 2010 27:286-298; Patil et al., Crit Rev Ther Drug Carrier Syst. 2008 25: 1-61; Benoit et al., Biomacromolecules. 2011 12:2708-2714; Zhao et al., Expert Opin Drug Deliv. 2008 5:309-319; Akinc et al., Mol Ther. 2010 18:1357-1364; Srinivasan et al., Methods Mol Biol. 2012 820: 105-116; Ben-Arie et al., Methods Mol Biol. 2012 757:497-507; Peer 2010 J Control Release. 20:63-68; Peer et al., Proc Natl Acad Sci USA. 2007 104:4095-4100; Kim et al., Methods Mol Biol. 2011 721:339-353; Subramanya et al., Mol Ther. 2010 18:2028-2037; Song et al., Nat Biotechnol. 2005 23:709-717; Peer et al., Science. 2008 319:627-630; Peer and Lieberman, Gene Ther. 2011 18:1127-1133; the contents of all of which are incorporated herein by reference in its entirety).

In one embodiment, a disrupting agent comprising a site-specific HNF4α targeting moiety of the invention, may be formulated as a solid lipid nanoparticle. A solid lipid nanoparticle (SLN) may be spherical with an average diameter between 10 to 1000 nm. SLN possess a solid lipid core matrix that can solubilize lipophilic molecules and may be stabilized with surfactants and/or emulsifiers. In a further embodiment, the lipid nanoparticle may be a self-assembly lipid-polymer nanoparticle (see Zhang et al., ACS Nano, 2008, 2 (8), pp 1696-1702; herein incorporated by reference in its entirety). As a non-limiting example, the SLN may be the SLN described in PCT Publication No. WO2013/105101, the contents of which are herein incorporated by reference in their entirety. As another non-limiting example, the SLN may be made by the methods or processes described in PCT Publication No. WO 2013/105101, the contents of which are herein incorporated by reference in their entirety.

Liposomes, lipoplexes, or lipid nanoparticles may be used to improve the efficacy of a disrupting agent comprising a site-specific HNF4α targeting moiety comprising, e.g., a nucleic acid molecule, to direct protein production as these formulations may be able to increase cell transfection by a nucleic acid molecule; and/or increase the translation of encoded protein (e.g., an effector of the invention). One such example involves the use of lipid encapsulation to enable the effective systemic delivery of polyplex plasmid DNA (Heyes et al., Mol Ther. 2007 15:713-720; the contents of which are herein incorporated by reference in its entirety). The liposomes, lipoplexes, or lipid nanoparticles of the invention may also increase the stability of a a disrupting agent comprising a site-specific HNF4α targeting moiety comprising, e.g., a nucleic acid molecule. Liposomes, lipoplexes, or lipid nanoparticles are described in U.S. Patent Publication No. 2016/0038612, the contents of which are incorporated herein by reference in their entirety.

In one embodiment, a disrupting agent comprising a site-specific HNF4α targeting moiety comprising may be formulated for controlled release and/or targeted delivery. As used herein, "controlled release" refers to a pharmaceutical composition or compound release profile that conforms to a particular pattern of release to effect a therapeutic outcome. In one embodiment, a disrupting agent comprising a site-specific HNF4α targeting moiety, as described herein, may be encapsulated into a delivery agent described herein and/or known in the art for controlled release and/or targeted delivery. As used herein, the term "encapsulate" means to enclose, surround or encase. As it relates to the formulation of the compounds of the invention, encapsulation may be substantial, complete or partial. The term "substantially encapsulated" means that at least greater than 50, 60, 70, 80, 85, 90, 95, 96, 97, 98, 99, 99.9, 99.9 or greater than 99.999% of the pharmaceutical composition or disrupting agent of the invention may be enclosed, surrounded or encased within the delivery agent. "Partial encapsulation" or "partially encapsulated" means that less than 10, 10, 20, 30, 40 50 or less of the pharmaceutical composition or disrupting agent of the invention may be enclosed, surrounded or encased within the delivery agent. Advantageously, encapsulation may be determined by measuring the escape or the activity of the pharmaceutical composition or compound of the invention using fluorescence and/or electron micrograph. For example, at least 1, 5, 10, 20, 30, 40, 50, 60, 70, 80, 85, 90, 95, 96, 97, 98, 99, 99.9, 99.99 or greater than 99.99% of the pharmaceutical composition or disrupting agent of the invention are encapsulated in the delivery agent.

In one embodiment, a disrupting agent comprising a site-specific HNF4α targeting moiety comprising as described herein, may be encapsulated in a therapeutic nanoparticle (e.g., a therapeutic nanoparticle from BIND Therapeutics). Therapeutic nanoparticles may be formulated by methods described herein and known in the art such as, but not limited to, PCT Publication Nos. WO 2010/005740, WO 2010/030763, WO 2010/005721, WO 2010/005723, WO 2012/054923, U.S. Patent Publication Nos. 2201/10262491, 2010/0104645, 2010/0087337, 2010/0068285, 2011/0274759, 2010/0068286, 2012/0288541, 2013/0123351, 2013/0230567, 2013/0236500, 2013/0302433, 2013/0302432, 1013/0280339 and 2013/0251757, and U.S. Pat. Nos. 8,206,747, 8,293,276 8,318,208, 8,318,211, 8,623, 417, 8,617,608, 8,613,954, 8,613,951, 8,609,142, 8,603,534 and 8,563,041; the contents of each of which is herein incorporated by reference in their entirety. In another embodiment, therapeutic polymer nanoparticles may be prepared by the methods described in U.S. Patent Publication No. 2012/0140790, herein incorporated by reference in its entirety. As a non-limiting example, the therapeutic nanoparticle may comprise about 4 to about 25 weight percent of a disrupting agent and about 10 to about 99 weight percent of a diblock poly (lactic) acid-poly (ethylene) glycol copolymer comprising poly(lactic) acid as described in US Patent Publication No. 2013/0236500 (Bind), the contents of which are herein incorporated by reference in its entirety. As another non-limiting example, the nanoparticle may comprise about 0.2 to about 35 weight percent of a disrupting agent and about 10 to about 99 weight percent of a diblock poly(lactic) acid-poly(ethylene)glycol copolymer as described in U.S. Patent Publication Nos. 2013/0280339 (Bind) and 2010251757 and U.S. Pat. No. 8,652,528, the contents of each of which are herein incorporated by reference in their entirety.

In one embodiment, a disrupting agent formulated in therapeutic nanoparticles may be administered intramuscularly, intradermally, or intravenously.

In one embodiment, a disrupting agent formulated in ACCURINS™ nanoparticles may be administered intramuscularly, intradermally, or intravenously.

In one embodiment, a disrupting agent may be delivered in therapeutic nanoparticles having a high glass transition temperature such as, but not limited to, the nanoparticles described in US Patent Publication Nos. 2014/0030351 and 2011/0294717, the entire contents of each of which are incorporated herein by reference.

In one embodiment, the therapeutic nanoparticle may be formulated for sustained release. As used herein, "sustained release" refers to a pharmaceutical composition or compound that conforms to a release rate over a specific period of time. The period of time may include, but is not limited to, hours, days, weeks, months and years. As a nonlimiting example, the sustained release nanoparticle may comprise a polymer and a disrupting agent of the present invention (see PCT Publication No. WO2010075072 and U.S. Patent Publication Nos. 2010/0216804, 2011/0217377, 2012/0201859, 2013/0243848 and 2013/0243827, each of which is herein incorporated by reference in their entirety).

In one embodiment, a disrupting agent of the invention may be encapsulated in, linked to and/or associated with synthetic nanocarriers. Synthetic nanocarriers include, but are not limited to, those described in PCT Publication. Nos. WO 2010/005740, WO 2010/030763, WO 2012/13501, WO 2012/149252, WO 2012149255, WO 2012149259, WO 2012149265, WO 2012149268, WO 2012149282, WO 2012149301, WO 2012149393, WO 2012149405, WO 2012149411 and WO 2012149454 and US Patent Publication Nos. 20110262491, 20100104645, 20100087337, 20120244222 and US20130236533, and U.S. Pat. No. 8,652,487, the contents of each of which is herein incorporated by reference in their entirety. The synthetic nanocarriers may be formulated using methods known in the art and/or described herein. As a nonlimiting example, the synthetic nanocarriers may be formulated by the methods described in PCT Publication Nos. WO 2010005740, WO 2010030763 and WO 201213501 and US Patent Publication Nos. 20110262491, 20100104645, 20100087337 and 20120244222, each of which is herein incorporated by reference in their entirety. In another embodiment, the synthetic nanocarrier formulations may be lyophilized by methods described in PCT Publication No. WO 2011072218 and U.S. Pat. No. 8,211,473; each of which is herein incorporated by reference in their entirety. In yet another embodiment, formulations of the present invention, including, but not limited to, synthetic nanocarriers, may be lyophilized or reconstituted by the methods described in US Patent Publication No. 20130230568, the contents of which are herein incorporated by reference in its entirety.

In one embodiment, synthetic nanocarriers comprising a disrupting agent may be administered intramuscularly, intradermally, or intravenously.

In some embodiments, a disrupting agent may be formulated for delivery using smaller LNPs. Such particles may comprise a diameter from below 0.1 µm up to 1000 µm such as, but not limited to, less than 0.1 µm, less than 1.0 µm, less than 5 µm, less than 10 µm, less than 15 µm, less than 20 µm, less than 25 µm, less than 30 µm, less than 35 µm, less than 40 µm, less than 50 µm, less than 55 µm, less than 60 µm, less than 65 µm, less than 70 µm, less than 75 µm, less than 80 µm, less than 85 µm, less than 90 µm, less than 95 µm, less than 100 µm, less than 125 µm, less than 150 µm, less than 175 tim, less than 200 µm, less than 225 µm, less than 250 µm, less than 275 µm, less than 300 µm, less than 325 µm, less than 350 µm, less than 375 µm, less than 400 µm, less than 425 µm, less than 450 tim, less than 475 µm, less than 500 µm, less than 525 µm, less than 550 µm, less than 575 µm, less than 600 µm, less than 625 µm, less than 650 µm, less than 675 µm, less than 700 µm, less than 725 tim, less than 750 µm, less than 775 µm, less than 800 µm, less than 825 µm, less than 850 µm, less than 875 µm, less than 900 µm, less than 925 µm, less than 950 µm, less than 975 µm.

In another embodiment, a disrupting agent may be formulated for delivery using smaller LNPs which may comprise a diameter from about 1 nm to about 100 nm, from about 1 nm to about 10 nm, about 1 nm to about 20 nm, from about 1 nm to about 30 nm, from about 1 nm to about 40 nm, from about 1 nm to about 50 nm, from about 1 nm to about 60 nm, from about 1 nm to about 70 nm, from about 1 nm to about 80 nm, from about 1 nm to about 90 nm, from about 5 nm to about from 100 nm, from about 5 nm to about 10 nm, about 5 nm to about 20 nm, from about 5 nm to about 30 nm, from about 5 nm to about 40 nm, from about 5 nm to about 50 nm, from about 5 nm to about 60 nm, from about 5 nm to about 70 nm, from about 5 nm to about 80 nm, from about 5 nm to about 90 nm, about 10 to about 50 nm, from about 20 to about 50 nm, from about 30 to about 50 nm, from about 40 to about 50 nm, from about 20 to about 60 nm, from about 30 to about 60 nm, from about 40 to about 60 nm, from about 20 to about 70 nm, from about 30 to about 70 nm, from about 40 to about 70 nm, from about 50 to about 70 nm, from about 60 to about 70 nm, from about 20 to about 80 nm, from about 30 to about 80 nm, from about 40 to about 80 nm, from about 50 to about 80 nm, from about 60 to about 80 nm, from about 20 to about 90 nm, from about 30 to about 90 nm, from about 40 to about 90 nm, from about 50 to about 90 nm, from about 60 to about 90 nm and/or from about 70 to about 90 nm.

In one embodiment, a disrupting agent may be formulated in smaller LNPs and may be administered intramuscularly, intradermrally, or intravenously.

In one embodiment, a disrupting agent may be formulated for delivery using the drug encapsulating microspheres described in PCT Patent Publication No. WO 2013063468 or U.S. Pat. No. 8,440,614, each of which is herein incorporated by reference in its entirety. In another aspect, the amino acid, peptide, polypeptide, lipids (APPL) are useful in delivering the disrupting agents of the invention to cells (see PCT Patent Publication No. WO 2013063468, herein incorporated by reference in its entirety).

In one aspect, the lipid nanoparticle may be a limit size lipid nanoparticle described in PCT Patent Publication No. WO 2013059922, herein incorporated by reference in its entirety. The limit size lipid nanoparticle may comprise a lipid bilayer surrounding an aqueous core or a hydrophobic core; where the lipid bilayer may comprise a phospholipid such as, but not limited to, diacylphosphatidylcholine, a diacylphosphatidylethanolamine, a ceramide, a sphingomyelin, a dihydrosphingomyelin, a cephalin, a cerebroside, a C8-C20 fatty acid diacylphophatidylcholine, and I-palmitoyl-2-oleoyl phosphatidylcholine (POPC). In another aspect the limit size lipid nanoparticle may comprise a polyethylene glycol-lipid such as, but not limited to, DLPEPEG, DMPE-PEG, DPPC-PEG and DSPE-PEG.

In one embodiment, a disrupting agent of the invention may be delivered, localized and/or concentrated in a specific location using the delivery methods described in PCT Patent Publication No. WO 2013063530, the contents of which are herein incorporated by reference in its entirety. As a nonlimiting example, a subject may be administered an empty polymeric particle prior to, simultaneously with or after delivering the disrupting agent to the subject. The empty polymeric particle undergoes a change in volume once in contact with the subject and becomes lodged, embedded, immobilized or entrapped at a specific location in the subject.

In one embodiment, a disrupting agent may be formulated in an active substance release system (See e.g., US Patent Publication No. 20130102545, herein incorporated by reference in its entirety). The active substance release system may comprise 1) at least one nanoparticle bonded to an oligonucleotide inhibitor strand which is hybridized with a catalytically active nucleic acid and 2) a compound bonded to at least one substrate molecule bonded to a therapeutically active substance (e.g., a disrupting agent of the invention), where the therapeutically active substance is released by the cleavage of the substrate molecule by the catalytically active nucleic acid.

In one embodiment, the nanoparticles of the present invention may be water soluble nanoparticles such as, but not limited to, those described in PCT Publication No. WO 2013090601, the contents of which are herein incorporated by reference in its entirety. The nanoparticles may be inorganic nanoparticles which have a compact and zwitterionic ligand in order to exhibit good water solubility. The nanoparticles may also have small hydrodynamic diameters (HD), stability with respect to time, pH, and salinity and a low level of non-specific protein binding.

In one embodiment, the nanoparticles of the present invention are stealth nanoparticles or target-specific stealth nanoparticles such as, but not limited to, those described in U.S. Patent Publication Nos. 20130172406 (Bind), US20130251817 (Bind), 2013251816 (Bind) and 20130251766 (Bind), the contents of each of which are herein incorporated by reference in its entirety. The stealth nanoparticles may comprise a diblock copolymer and a chemotherapeutic agent. These stealth nanoparticles may be made by the methods described in US Patent Publication Nos. 20130172406, 20130251817, 2013251816 and 20130251766, the contents of each of which are herein incorporated by reference in its entirety. As a non-limiting example, the stealth nanoparticles may target cancer cells such as the nanoparticles described in US Patent Publication Nos. 20130172406, 20130251817, 2013251816 and 20130251766, the contents of each of which are herein incorporated by reference in its entirety.

In one embodiment, stealth nanoparticles comprising a disrupting agent of the invention may be administered intramuscularly, intradermally, or intravenously.

In one embodiment, a disrupting agent of the invention may be formulated in and/or delivered in a lipid nanoparticle comprising a plurality of cationic lipids such as, but not limited to, the lipid nanoparticles described in US Patent Publication No. 20130017223, the contents of which are herein incorporated by reference in its entirety. As a non-limiting example, the LNP formulation may comprise a first cationic lipid and a second cationic lipid. As another non-limiting example, the LNP formulation may comprise DLin-MC2-DMA and DLinMC4-DMA. As yet another non-limiting example, the LNP formulation may comprise DLin-MC3-DMA and CI2-200. In one embodiment, the LNP formulations comprising a plurality of cationic lipids (such as, but not limited to, those described in US Patent Publication No. US20130017223, the contents of which are herein incorporated by reference in its entirety) and may be administered intramuscularly, intradermally, or intravenously.

In one embodiment, a disrupting agent as described herein, may be formulated in and/or delivered in a lipid nanoparticle comprising the cationic lipid DLin-MC3-DMA and the neutral lipid DOPE. The lipid nanoparticle may also comprise a PEG based lipid and a cholesterol or antioxidant. These lipid nanoparticle formulations comprising DLin-MC3-DMA and DOPE and a disrupting agent may be administered intramuscularly, intradermally, or intravenously.

In one embodiment, the lipid nanoparticle comprising DLin-MC3-DMA and DOPE may comprise a PEG lipid such as, but not limited to, pentaerythritol PEG ester tetra-succinimidyl and pentaerythritol PEG ether tetra-thiol, PEGc-DOMG, PEG-DMG (1,2-Dimyristoyl-sn-glycerol, methoxypolyethylene Glycol), PEG-DSG (1,2-Distearoyl-snglycerol, methoxypolyethylene Glycol), PEG-DPG (1,2-Dipalmitoyl-sn-glycerol, methoxypolyethylene glycol), PEG-DSA (PEG coupled to 1,2-distearyloxypropyl-3-amine), PEG-DMA (PEG coupled to 1,2-dimyristyloxypropyl-3-amine, PEG-c-DNA, PEG-c-DMA, PEG-S-DSG, PEG-c-DMA, PEG-DPG, PEG-DMG 2000 and those described herein and/or known in the art.

In one embodiment, the lipid nanoparticle comprising DLin-MC3-DMA and DOPE may include 0.5% to about 3.0%, from about 1.0% to about 3.5%, from about 1.5% to about 4.0%, from about 2.0% to about 4.5%, from about 2.5% to about 5.0% and/or from about 3.0% to about 6.0% of the lipid molar ratio of a PEG lipid.

In one embodiment, the lipid nanoparticle comprising DLin-MC3-DMA and DOPE may include 25.0% cholesterol to about 50.0% cholesterol, from about 30.0% cholesterol to about 45.0% cholesterol, from about 35.0% cholesterol to about 50.0% cholesterol and/or from about 48.5% cholesterol to about 60% cholesterol. In one embodiment, formulations may comprise a percentage of cholesterol selected from the group consisting of 28.5%, 31.5%, 33.5%, 36.5%, 37.0%, 38.5%, 39.0%, 43.5% and 48.5%.

In one embodiment, the lipid nanoparticle comprising DLin-MC3-DMA and DOPE may include 25.0% antioxidant to about 50.0% antioxidant, from about 30.0% antioxidant to about 45.0% antioxidant, from about 35.0% antioxidant to about 50.0% antioxidant and/or from about 48.5% antioxidant to about 60% antioxidant. In one embodiment, formulations may comprise a percentage of antioxidant selected from the group consisting of 28.5%, 31.5%, 33.5%, 36.5%, 37.0%, 38.5%, 39.0%, 43.5% and 48.5%.

The disrupting agent of the invention can be formulated using natural and/or synthetic polymers. Non-limiting examples of polymers which may be used for delivery include, but are not limited to, DYNAMIC POLYCONJUGATE® (Arrowhead Research Corp., Pasadena, Calif.) formulations from MIRUS® Bio (Madison, Wis.) and Roche Madison (Madison, Wis.), PHASERX™ polymer formulations such as, without limitation, SMARTT POLYMER TECHNOLOGY™ (Seattle, Wash.), DMRIIDOPE, poloxamer, VAXFECTIN® adjuvant from Vical (San Diego, Calif.), chitosan, cyclodextrin from Calando Pharmaceuticals (Pasadena, Calif.), dendrimers and poly(lactic-co-glycolic acid) (PLGA) polymers, RONDEL™ (RNAi/Oligonucleotide Nanoparticle Delivery) polymers (Arrowhead Research Corporation, Pasadena, Calif.) and pH responsive co-block polymers such as, but not limited to, PHASERX™ (Seattle, Wash.).

The polymer formulations may permit the sustained or delayed release of a disrupting agent (e.g., following intramuscular, intradermal or subcutaneous injection). The altered release profile of the disrupting agent can result in, for example, translation of an encoded protein over an extended period of time. The polymer formulation may also be used to increase the stability of the disrupting agent. For example, biodegradable polymers have been previously used to protect nucleic acids other than modified mRNA from degradation and been shown to result in sustained release of payloads in vivo (Rozema et al., Proc Natl Acad Sci USA. 2007 104:12982-12887; Sullivan et al., Expert Opin Drug Deliv. 2010 7:1433-1446; Convertine et al., Biomacromolecules. 2010 Oct. 1; Chu et al., Acc Chem Res. 2012 Jan. 13; Manganiello et al et al., Biomaterials. 2012 33:2301-2309; Benoit et al., Biomacromolecules. 2011 12:2708-2714; Singha et al., Nucleic Acid Ther. 2011 2: 133-147; deFougerolles Hnm Gene Ther. 2008 19:125-132; Schaffert and Wagner, Gene Ther. 2008 16:1131-1138; Chaturvedi et al., Expert Opin Drug Deliv. 2011 8: 1455-1468; Davis, Mol Pharm. 2009 6:659-668; Davis, Nature 201 0464: 1067-1070; each of which is herein incorporated by reference in its entirety).

In one embodiment, the pharmaceutical compositions may be sustained release formulations. In a further embodiment, the sustained release formulations may be for subcutaneous delivery. Sustained release formulations may include, but are not limited to, PLGA microspheres, ethylene vinyl acetate (EVAc), poloxamer, GELSITE® (Nanotherapeutics, Inc. Alachua, Fla.), HYLENEX® (Halozyme Therapeutics, San Diego Calif.), surgical sealants such as fibrinogen polymers (Ethic on Inc. Cornelia, Ga.), TISSELL® (Baxter International, Inc Deerfield, Ill.), PEG-based sealants, and COSEAL® (Baxter International, Inc Deerfield, Ill.).

B. Vector Encoded Site-Specific HNF4α Disrupting Agents of the Invention

Disrupting agents comprising a site-specific HNF4α targeting moiety, e.g., comprising a nucleic acid molecule, may be expressed from transcription units inserted into DNA or RNA vectors (see, e.g., Couture, A, et al., *TIG*. (1996), 12:5-10; WO 00/22113, WO 00/22114, and U.S. Pat. No. 6,054,299). In some embodiment, expression is sustained (months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., (1995) *Proc. Natl. Acad. Sci. USA* 92:1292). Different components of the disrupting agent, e.g., gRNA and effector, can be located on separate expression vectors that can be co-introduced (e.g., by transfection or infection) into a target cell. Alternatively, each individual component can be transcribed by promoters both of which are located on the same expression plasmid.

Delivery of a disrupting agent expressing vector can be systemic, such as by intravenous or intramuscular administration, by administration to target cells ex-planted from the patient followed by reintroduction into the patient, or by any other means that allows for introduction into a desired target cell.

In certain embodiment, the nucleic acids described herein or the nucleic acids encoding a protein described herein, e.g., an effector, are incorporated into a vector, e.g., a viral vector.

The individual strand or strands of a disrupting agent comprising a site-specific HNF4α targeting moiety comprising a nucleic acid molecule can be transcribed from a promoter in an expression vector. Where two separate strands are to be expressed to generate, for example, a dsRNA, two separate expression vectors can be co-introduced (e.g., by transfection or infection) into a target cell. Alternatively, each individual strand of a nucleic acid molecule can be transcribed by promoters both of which are located on the same expression plasmid. In one embodiment, a nucleic acid molecule is expressed as inverted repeat polynucleotides joined by a linker polynucleotide sequence such that the nucleic acid molecule has a stem and loop structure.

Expression vectors are generally DNA plasmids or viral vectors. Expression vectors compatible with eukaryotic cells, preferably those compatible with vertebrate cells, can be used to produce recombinant constructs for the expression of a disrupting agent as described herein.

Constructs for the recombinant expression of a disrupting agent will generally require regulatory elements, e.g., promoters, enhancers, etc., to ensure the expression of the disrupting agent in target cells.

Expression of natural or synthetic nucleic acids is typically achieved by operably linking a nucleic acid encoding the nucleic acid of interest to a regulatory region, such as a promoter, and incorporating the construct into an expression vector. The vectors can be suitable for replication and integration in eukaryotes.

Regulatory regions, such as a promoter, suitable for operable linking to a nucleic acid molecules can be operably linked to a regulatory region such as a promoter. can be from any species. Any type of promoter can be operably linked to a nucleic acid sequence. Examples of promoters include, without limitation, tissue-specific promoters, constitutive promoters, and promoters responsive or unresponsive to a particular stimulus (e.g., inducible promoters). Additional promoter elements, e.g., enhancing sequences, regulate the frequency of transcriptional initiation. Typically, these are located in the region 30-110 bp upstream of the start site, although a number of promoters have recently been shown to contain functional elements downstream of the start site as well. The spacing between promoter elements frequently is flexible, so that promoter function is preserved when elements are inverted or moved relative to one another. In the thymidine kinase (tk) promoter, the spacing between promoter elements can be increased to 50 bp apart before activity begins to decline. Depending on the promoter, individual elements can function either cooperatively or independently to activate transcription.

One example of a suitable promoter is the immediate early cytomegalovirus (CMV) promoter sequence. This promoter sequence is a strong constitutive promoter sequence capable of driving high levels of expression of any polynucleotide sequence operatively linked thereto. Another example of a suitable promoter is Elongation Growth Factor-1a (EF-1a). However, other constitutive promoter sequences may also be used, including, but not limited to the simian virus 40 (SV40) early promoter, mouse mammary tumor virus (MMTV), human immunodeficiency virus (HIV) long terminal repeat (LTR) promoter, MoMuLV promoter, an avian leukemia virus promoter, an Epstein-Barr virus immediate early promoter, a Rous sarcoma virus promoter, as well as human gene promoters such as, but not limited to, the actin promoter, the myosin promoter, the hemoglobin promoter, and the creatine kinase promoter.

Further, the present invention should not be limited to the use of constitutive promoters. Inducible promoters are also contemplated as part of the invention. The use of an inducible promoter provides a molecular switch capable of turning on expression of the polynucleotide sequence which it is operatively linked when such expression is desired, or turning off the expression when expression is not desired. Examples of inducible promoters include, but are not limited to a metallothionine promoter, a glucocorticoid promoter, a progesterone promoter, and a tetracycline promoter.

Additional regulatory regions that may be useful in nucleic acid constructs, include, but are not limited to, transcription and translation terminators, initiation sequences, polyadenylation sequences, translation control sequences (e.g., an internal ribosome entry segment, IRES), enhancers, inducible elements, or introns. Such regulatory regions may not be necessary, although they may increase expression by affecting transcription, stability of the mRNA, translational efficiency, or the like. Such regulatory regions can be included in a nucleic acid construct as desired to obtain optimal expression of the nucleic acids in the cell(s). Sufficient expression, however, can sometimes be obtained without such additional elements.

The expression vector to be introduced can also contain either a selectable marker gene or a reporter gene or both to facilitate identification and selection of expressing cells from the population of cells sought to be transfected or infected through viral vectors. In other aspects, the selectable marker may be carried on a separate piece of DNA and used in a co-transfection procedure. Both selectable markers and reporter genes may be flanked with appropriate transcriptional control sequences to enable expression in the host cells. Useful selectable markers include, for example, antibiotic-resistance genes, such as neo and the like. Non-limiting examples of selectable markers include puromycin, ganciclovir, adenosine deaminase (ADA), aminoglycoside phosphotransferase (neo, G418, APH), dihydrofolate reductase (DHFR), hygromycin-B-phosphtransferase, thymidine kinase (TK), and xanthin-guanine phosphoribosyltransferase (XGPRT). Such markers are useful for selecting stable transformants in culture. Other selectable markers include fluorescent polypeptides, such as green fluorescent protein or yellow fluorescent protein.

Signal peptides may also be included and can be used such that an encoded polypeptide is directed to a particular cellular location (e.g., the cell surface).

Reporter genes may be used for identifying potentially transfected cells and for evaluating the functionality of transcriptional control sequences. In general, a reporter gene is a gene that is not present in or expressed by the recipient source and that encodes a polypeptide whose expression is manifested by some easily detectable property, e.g., enzymatic activity. Expression of the reporter gene is assayed at a suitable time after the DNA has been introduced into the recipient cells. Suitable reporter genes may include genes encoding luciferase, beta-galactosidase, chloramphenicol acetyl transferase, secreted alkaline phosphatase, or the green fluorescent protein gene (e.g., Ui-Tei et al., 2000 FEBS Letters 479: 79-82). Suitable expression systems are well known and may be prepared using known techniques or obtained commercially. In general, the construct with the minimal 5' flanking region showing the highest level of expression of reporter gene is identified as the promoter. Such promoter regions may be linked to a reporter gene and used to evaluate agents for the ability to modulate promoter-driven transcription.

Other aspects to consider for vectors and constructs are known in the art.

In some embodiments, a vector, e.g., a viral vector comprises a disrupting agent comprising a site-specific HNF4α targeting moiety comprising a nucleic acid molecule.

Viral vector systems which can be utilized with the methods and compositions described herein include, but are not limited to, (a) adenovirus vectors (e.g., an Ad5/F35 vector); (b) retrovirus vectors, including but not limited to lentiviral vectors (including integration competent or integration-defective lentiviral vectors), moloney murine leukemia virus, etc.; (c) adeno-associated virus vectors; (d) herpes simplex virus vectors; (e) SV 40 vectors; (f) polyoma virus vectors; (g) papilloma virus vectors; (h) picornavirus vectors; (i) pox virus vectors such as an orthopox, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The constructs can include viral sequences for transfection, if desired. Alternatively, the construct can be incorporated into vectors capable of episomal replication, e.g. EPV and EBV vectors. See, e.g., U.S. Pat. Nos. 6,534,261; 6,607,882; 6,824,978; 6,933,113; 6,979,539; 7,013,219; and 7,163,824, the entire contents of each of which is incorporated by reference herein.

Vectors, including those derived from retroviruses such as adenoviruses and adeno-associated viruses and lentiviruses, are suitable tools to achieve long-term gene transfer since they allow long-term, stable integration of a transgene and its propagation in daughter cells. Examples of vectors include expression vectors, replication vectors, probe generation vectors, and sequencing vectors. The expression vector may be provided to a cell in the form of a viral vector. Viral vector technology is well known in the art, and described in a variety of virology and molecular biology manuals.

In one embodiment, a suitable viral vector for use in the present invention is an adeno-associated viral vector, such as a recombinant adeno-associate viral vector.

Recombinant adeno-associated virus vectors (rAAV) are gene delivery systems based on the defective and nonpathogenic parvovirus adeno-associated type 2 virus. All vectors are derived from a plasmid that retains only the AAV 145 bp inverted terminal repeats flanking the transgene expression cassette. Efficient gene transfer and stable transgene delivery due to integration into the genomes of the transduced cell are key features for this vector system. (Wagner et al., Lancet 351:9117 1702-3 (1998), Kearns et al., *Gene Ther.* 9:748-55 (1996)). AAV serotypes, including AAV1, AAV2, AAV3, AAV4, AAV5, AAV6, AAV7, AAV8 and AAV9, can be used in accordance with the present invention.

Replication-deficient recombinant adenoviral vectors (Ad) can be produced at high titer and readily infect a number of different cell types. Most adenovirus vectors are engineered such that a transgene replaces the Ad E1a, E1b, and/or E3 genes; subsequently the replication defective vector is propagated in human 293 cells that supply deleted gene function in trans. Ad vectors can transduce multiple types of tissues in vivo, including nondividing, differentiated cells such as those found in liver, kidney and muscle. Conventional Ad vectors have a large carrying capacity. An example of the use of an Ad vector in a clinical trial involved polynucleotide therapy for antitumor immunization with intramuscular injection (Sterman et al., Hum. Gene Ther. 7:1083-9 (1998)). Additional examples of the use of adenovirus vectors for gene transfer in clinical trials include Rosenecker et al., Infection 24:1 5-10 (1996); Sterman et al., Hum. Gene Ther. 9:7 1083-1089 (1998); Welsh et al., Hum. Gene Ther. 2:205-18 (1995); Alvarez et al., Hum. Gene Ther. 5:597-613 (1997); Topf et al., Gene Ther. 5:507-513 (1998); Sterman et al., Hum. Gene Ther. 7:1083-1089 (1998).

Packaging cells are used to form virus particles that are capable of infecting a host cell. Such cells include 293 cells, which package adenovirus, and kv2 cells or PA317 cells, which package retrovirus. Viral vectors used in gene therapy are usually generated by a producer cell line that packages a nucleic acid vector into a viral particle. The vectors typically contain the minimal viral sequences required for packaging and subsequent integration into a host (if applicable), other viral sequences being replaced by an expression cassette encoding the protein to be expressed. The missing viral functions are supplied in trans by the packaging cell line. For example, AAV vectors used in gene therapy typically only possess inverted terminal repeat (ITR) sequences from the AAV genome which are required for packaging and integration into the host genome. Viral DNA is packaged in a cell line, which contains a helper plasmid encoding the other AAV genes, namely rep and cap, but lacking ITR sequences. The cell line is also infected with adenovirus as a helper. The helper virus promotes replication of the AAV vector and expression of AAV genes from the helper plasmid. The helper plasmid is not packaged in significant amounts due to a lack of ITR sequences. Contamination with adenovirus can be reduced by, e.g., heat treatment to which adenovirus is more sensitive than AAV.

IV. Methods of the Invention

The present invention also provides methods of use of the agents and compositions described herein to modulate expression of hepatocyte nuclear factor 4 alpha-(HNF4α) in a cell. The methods include contacting the cell with a site-specific HNF4α disrupting agent, the disrupting agent comprising a site-specific HNF4α targeting moiety which targets an HNF4α expression control region, and an effector molecule, thereby modulating expression of HNF4α in the cell. The site-specific disrupting agent, the effector, or both the site-specific disrupting agent and the effector may be present in a composition, such as a composition described above. In some embodiments, the site-specific disrupting agent and the effector are present in the same compositions. In other embodiments, the site-specific disrupting agent and the effector are present in different compositions. In some embodiments, the methods of the invention include contacting a cell with two site-specific HNF4α disrupting agents (a first and a second agent). The two site specific HNF4α disrupting agents may be present in the same composition, e.g., pharmaceutical composition, e.g., pharmaceutical composition comprising an LNP, or in separate compositions, e.g., pharmaceutical composition, e.g., pharmaceutical composition comprising an LNP. The cell may be contacted with the first site specific HNF4α disrupting agent at one time and contacted with the second site specific HNF4α disrupting agent at a second time, or the cell may be contacted with both agents at the same time.

As indicated above, in fibrotic liver disease, HNF4α is dysregulated and, as a result, gene expression in its network declines significantly or stops. As reported by Guzman-Lepe (Guzman-Lepe J, et al. Liver-enriched transcription factor expression relates to chronic hepatic failure in humans. Hepatol Commun. 2018; 2(5):582-594. doi:10.1002/hep4.1172), HNF4α expression was down-regulated and correlated well with the extent of liver dysfunction (P=0.001), stage of fibrosis (P=0.0005), and serum levels of total bilirubin (P=0.009; r=0.35), albumin (P<0.001; r=0.52), and prothrombin time activity (P=0.002; r=0.41). HNF4α expression also correlated with CYP3A4, ornithine transcarbamylase (OTC), and F7 as well as CDH1 RNA levels. This dysregulation of the network contributes to the pathology of liver failure in the organ itself, and to co-morbidities throughout the patient. In addition to a repression of proteins associated with healthy liver (e.g. albumin and CYP3A enzyme production), proteins that contribute to the production of fibrosis are activated, including COL1a1 and αSMA.

Proof of principle that increased expression of HNF4α can revert senescent and irreversibly dysfunctional hepatocytes from terminal rodent livers to normal function has been established in several studies (Nishikawa, supra; Scholten D, Trebicka J, Liedtke C, Weiskirchen R. The carbon tetrachloride model in mice. Lab Anim 2015; 49(1 Suppl):4-11. doi:10.1177/0023677215571192; Varga J, Brenner D A, Phan S H, eds. Fibrosis Research: Methods and Protocols. Humana Press; 2005. doi:10.1385/1592599400). Interestingly, as reported by Nishikawa et al. (Nishikawa, supra), reversal of the distorted extracellular matrix is not absolutely required to reverse hepatic failure in degenerative liver disease, as only minimal resolution of fibrosis was found by histology two weeks after forced re-expression of HNF4α, well after improvement in hepatic function was documented. Significant improvement in histology, however, was observed at 100 days. In addition, long-term correction took place despite that forced re-expression generated only 0.01% of the endogenous level of HNF4α. Thus, improvement in hepatic function may only require increasing expression of HNF4α in a relatively modest number of hepatocytes in end-stage degenerative disease.

Recently, Huang et al. (Huang K-W, et al. Liver Activation of Hepatocellular Nuclear Factor-4a by Small Activating RNA Rescues Dyslipidemia and Improves Metabolic Profile. Mol Ther Nucleic Acids. 2019; 19:361-370. doi:10.1016/j.omtn.2019.10.044) also observed that stimulating HNF4α expression with a small-activating RNA in a rat model of non-alcoholic fatty liver disease (NAFLD) restored metabolic regulation and improved lipid profile.

As demonstrated in the examples below, one embodiment of the invention is to increase the expression of the HNF4α gene by delivering an engineered transcription factor to the gene that is pathologically dysregulated. The transcriptional activator, VPR (Chavez A, et al. Highly efficient Cas9-mediated transcriptional programming Nat Methods. 2015; 12(4):326-328. doi:10.1038/nmeth.3312), is a concatemer of the HSV transcriptional activator VP16, nuclear factor NF-kappa-B p65 subunit, and the EBV R transactivator. Each of these transcription factors is capable, individually, of attracting the cellular machinery of transcription, resulting in an upregulation of RNA production from the target locus. As a group, their synergistic cooperation results in physiologic or supra-physiologic expression of a target gene.

Expression of HNF4α may be enhanced or reduced as compared to, for example, a cell that was not contacted with the site-specific HNF4α disrupting agent. Modulation in gene expression can be assessed by any methods known in the art. For example, a modulation in the expression may be determined by determining the mRNA expression level of a gene, e.g., in a cell, a plurality of cells, and/or a tissue sample, using methods routine to one of ordinary skill in the art, e.g., northern blotting, qRT-PCR; by determining the protein level of a gene using methods routine to one of ordinary skill in the art, such as western blotting, immunological techniques.

The term "reduced" in the context of the level of HNF4α gene expression or HNF4α protein production in a subject, or a disease marker or symptom refers to a statistically significant decrease in such level. The decrease can be, for example, at least 20%, 25%, 30%, 35%, 40%, 45%, 50%, 55%, 60%, 65%, 70%, 75%, 80%, 85%, 90%, or 95%, or below the level of detection for the detection method. In certain embodiments, the expression of the target is normalized, i.e., decreased towards or to a level accepted as within the range of normal for an individual without such disorder.

As used here, "lower" in a subject can refer to lowering of gene expression or protein production in a cell in a subject does not require lowering of expression in all cells or tissues of a subject. For example, as used herein, lowering in a subject can include lowering of gene expression or protein production in the liver of a subject.

The term "reduced" can also be used in association with normalizing a symptom of a disease or condition, i.e. decreasing the difference between a level in a subject suffering from an HNF4α-associated disease towards or to a level in a normal subject not suffering from an HNF4α-associated disease. As used herein, if a disease is associated with an elevated value for a symptom, "normal" is considered to be the upper limit of normal. If a disease is associated with a decreased value for a symptom, "normal" is considered to be the lower limit of normal.

The term "enhanced" in the context of the level of HNF4α gene expression or HNF4α protein production in a subject, or a disease marker or symptom refers to a statistically significant increase in such level. The increase can be, for example, at least 20%, 25%, 30%, 35%, 40%, 45%, 50%, 55%, 60%, 65%, 70%, 75%, 80%, 85%, 90%, or 95%, or above the level of detection for the detection method. In certain embodiments, the expression of the target is normalized, i.e., increase towards or to a level accepted as within the range of normal for an individual without such disorder. As used here, "higher" in a subject can refer to increasing gene expression or protein production in a cell in a subject does not require increasing expression in all cells or tissues of a subject. For example, as used herein, increasing in a subject can include increasing gene expression or protein production in the liver of a subject.

The term "enhanced" can also be used in association with normalizing a symptom of a disease or condition, i.e. increasing the difference between a level in a subject suffering from an HNF4α-associated disease towards or to a level in a normal subject not suffering from an HNF4α-associated disease. As used herein, if a disease is associated with an elevated value for a symptom, "normal" is considered to be the upper limit of normal. If a disease is associated with a decreased value for a symptom, "normal" is considered to be the lower limit of normal.

In some embodiments, a suitable cell for use in the methods of the invention is a mammalian cell. In some embodiments, the cell is a somatic cell. In some embodiments, the cell is a primary cell. For example, in some embodiments, the cell is a mammalian somatic cell. In some embodiments, the mammalian somatic cell is a primary cell. In some embodiments, the mammalian somatic cell is a non-embryonic cell.

The step of contacting may be performed in vitro, in vivo (i.e., the cell may be within a subject), or ex vivo. In some embodiments, contacting a cell is performed ex vivo and the methods further include, prior to the step of contacting, a step of removing the cell (e.g., a mammalian cell) from a subject. In some embodiments, the methods further comprise, after the step of contacting, a step of (b) administering the cell (e.g., mammalian cells) to a subject.

The in vivo methods of the invention may include administering to a subject an agent or composition of the invention.

The term "subject," as used herein refers to an organism, for example, a mammal (e.g., a human, a non-human mammal, a non-human primate, a primate, a laboratory animal, a mouse, a rat, a hamster, a gerbil, a cat, or a a dog). In some embodiments a human subject is an adult, adolescent, or pediatric subject. In some embodiments, a subject had a disease or a condition. In some embodiments, the subject is suffering from a disease, disorder or condition, e.g., a disease, disorder or condition that can be treated as provided herein. In some embodiments, a subject is susceptible to a disease, disorder, or condition; in some embodiments, a susceptible subject is predisposed to and/or shows an increased risk (as compared to the average risk observed in a reference subject or population) of developing the disease, disorder or condition. In some embodiments, a subject displays one or more symptoms of a disease, disorder or condition. In some embodiments, a subject does not display a particular symptom (e.g., clinical manifestation of disease) or characteristic of a disease, disorder, or condition. In some embodiments, a subject does not display any symptom or characteristic of a disease, disorder, or condition. In some embodiments, a subject is a patient. In some embodiments, a subject is an individual to whom diagnosis and/or therapy is and/or has been administered.

Subjects that would benefit from the methods of the invention include subjects having an "HNF4α-associated disease" or a subject at risk of an "HNF4α-associated disease."

Thus, the present invention further provides methods of treatment of a subject in need thereof. The treatment methods of the invention include administering an agent or composition of the invention to a subject, e.g., a subject that would benefit from a modulation of HNF4α expression, such as a subject having an HNF4α-associated disease, in a therapeutically effective amount. In some embodiments, the methods of the invention include the subject may be administered two site-specific HNF4α disrupting agents (a first and a second agent). The two site specific HNF4α disrupting agents may be present in the same composition, e.g., pharmaceutical composition, e.g., pharmaceutical composition comprising an LNP, or in separate compositions, e.g., pharmaceutical composition, e.g., pharmaceutical composition comprising an LNP. The subject may be administered the first site specific HNF4α disrupting agent at one time and administered the second site specific HNF4α disrupting agent at a second time, or the subject may be administered both agents at the same time.

In addition, the present invention provides methods for preventing at least one symptom in a subject that would benefit from a modulation of HNF4α expression, such as a subject having an HNF4α-associated disease, by administering to the subject an agent or composition of the invention in a prophylactically effective amount.

"Therapeutically effective amount," as used herein, is intended to include the amount of an agent or composition that, when administered to a patient for treating a subject having a HNF4α-associated disease, is sufficient to effect treatment of the disease (e.g., by diminishing, ameliorating, or maintaining the existing disease or one or more symptoms of disease or its related comorbidities). The "therapeutically effective amount" may vary depending on the agent or composition, how it is administered, the disease and its severity and the history, age, weight, family history, genetic makeup, stage of pathological processes mediated by HNF4α gene expression, the types of preceding or concomitant treatments, if any, and other individual characteristics of the patient to be treated.

"Prophylactically effective amount," as used herein, is intended to include the amount of an agent or composition that, when administered to a subject who does not yet experience or display symptoms of an HNF4α-associated disease, but who may be predisposed to an HNF4α-associated disease, is sufficient to prevent or delay the development or progression of the disease or one or more symptoms of the disease for a clinically significant period of time. The "prophylactically effective amount" may vary depending on the agent or composition, how it is administered, the degree of risk of disease, and the history, age, weight, family history, genetic makeup, the types of preceding or concomitant treatments, if any, and other individual characteristics of the patient to be treated.

As used herein, "prevention" or "preventing," when used in reference to a disease, disorder or condition thereof, that would benefit from a reduction in expression of an HNF4α gene or production of HNF4α protein, refers to a reduction in the likelihood that a subject will develop a symptom associated with such a disease, disorder, or condition, e.g., a sign or symptom of HNF4α gene expression or HNF4α activity.

A "therapeutically-effective amount" or "prophylactically effective amount" also includes an amount of an agent or composition that produces some desired local or systemic effect at a reasonable benefit/risk ratio applicable to any treatment. Agents and compositions employed in the methods of the present invention may be administered in a sufficient amount to produce a reasonable benefit/risk ratio applicable to such treatment. In some embodiments, a therapeutically effective amount or prophylactically effect amount tis administered in a single dose; in some embodiments, multiple unit doses are required to deliver a therapeutically or prophylactically effective amount.

As used herein, the phrase "symptoms are reduced" may be used when one or more symptoms of a particular disease, disorder or condition is reduced in magnitude (e.g., intensity, severity, etc.) and/or frequency. In some embodiments, a delay in the onset of a particular symptom is considered one form of reducing the frequency of that symptom.

When the subject to be treated is a mammal such as a human, the composition can be administered by any means known in the art including, but not limited to oral, intraperitoneal, or parenteral routes, including intracranial (e.g., intraventricular, intraparenchymal, and intrathecal), intravenous, intramuscular, subcutaneous, transdermal, airway (aerosol), nasal, rectal, and topical (including buccal and sublingual) administration. In certain embodiments, the compositions are administered by intravenous infusion or injection. In certain embodiments, the compositions are administered by subcutaneous injection.

As used herein, the term "HNF4α-associated disease," is a disease or disorder that is caused by, or associated with HNF4α gene expression or HNF4α protein production. The term "HNF4α-associated disease" includes a disease, disorder or condition that would benefit from a decrease in HNF4α gene expression, replication, or protein activity. Non-limiting examples of HNF4α-associated diseases include, for example, liver disease (e.g., fatty liver, steatohepatitis including non-alcoholic steatohepatitis (NASH)), inflammatory bowel disease (IBD), hepatocellular carcinoma, MODY I, polycystic kidney disease, dyslipidemia (e.g., hyperlipidemia, high LDL cholesterol, low HDL cholesterol, hypertriglyceridemia, postprandial hypertriglyceridemia), disorders of glycemic control (e.g., insulin resistance not related to immune response to insulin, type 2 diabetes), cardiovascular disease (e.g., hypertension, endothelial cell dysfunction), kidney disease (e.g., acute kidney disorder, tubular dysfunction, proinflammatory changes to the proximal tubules, chronic kidney disease), metabolic syndrome, disease of lipid deposition or dysfunction (e.g., adipocyte dysfunction, visceral adipose deposition, obesity), disease of elevated uric acid (e.g., hyperuricemia, gout), and eating disorders such as excessive sugar craving. Details regarding signs and symptoms of the various diseases or conditions are well known in the art.

In one embodiment, the HNF4α-associated disease is selected from the group consisting of fatty liver (steatosis), nonalcoholic steatohepatitis (NASH), cirrhosis of the liver, accumulation of fat in the liver, inflammation of the liver, hepatocellular necrosis, liver fibrosis, and nonalcoholic fatty liver disease (NAFLD), polycystic kidney disease, inflammatory bowel disease (IBD), and MODY I.

Administration of the agents or compositions according to the methods of the invention may result in a reduction of the severity, signs, symptoms, or markers of an HNF4α-associated disease or disorder in a patient with an HNF4α-associated disease or disorder. By "reduction" in this context is meant a statistically significant decrease in such level. The reduction (absolute reduction or reduction of the difference between the elevated level in the subject and a normal level) can be, for example, at least about 20%, 25%, 30%, 35%, 40%, 45%, 50%, 55%, 60%, 65%, 70%, 75%, 80%, 85%, 90%, or 95%, or to below the level of detection of the assay used.

Administration of the agents or compositions according to the methods of the invention may stably or transiently modulating expression of a target gene. In some embodiments, a modulation of expression persists for at least about 1 hr to about 30 days, or at least about 2 hrs, 6 hrs, 12 hrs, 18 hrs, 24 hrs, 2 days, 3, days, 4 days, 5 days, 6 days, 7 days, 8 days, 9 days, 10 days, 11 days, 12 days, 13 days, 14 days, 15 days, 16 days, 17 days, 18 days, 19 days, 20 days, 21 days, 22 days, 23 days, 24 days, 25 days, 26 days, 27 days, 28 days, 29 days, 30 days, or longer or any time therebetween. In some other embodiments, a modulation of expression persists for no more than about 30 mins to about 7 days, or no more than about 1 hr, 2 hrs, 3 hrs, 4 hrs, 5 hrs, 6 hrs, 7 hrs, 8 hrs, 9 hrs, 10 hrs, 11 hrs, 12 hrs, 13 hrs, 14 hrs, 15 hrs, 16 hrs, 17 hrs, 18 hrs, 19 hrs, 20 hrs, 21 hrs, 22 hrs, 24 hrs, 36 hrs, 48 hrs, 60 hrs, 72 hrs, 4 days, 5 days, 6 days, 7 days, or any time therebetween.

The agents or compositions may be administered once to the subject or, alternatively, multiple administrations may be performed over a period of time. For example, two, three, four, five, or more administrations may be given to the subject during one treatment or over a period of time. In some embodiments, six, eight, ten, 12, 15 or 20 or more administrations may be given to the subject during one treatment or over a period of time as a treatment regimen.

In some embodiments, administrations may be given as needed, e.g., for as long as symptoms associated with the disease, disorder or condition persist. In some embodiments, repeated administrations may be indicated for the remainder of the subject's life. Treatment periods may vary and could be, e.g., one day, two days, three days, one week, two weeks, one month, two months, three months, six months, a year, or longer.

Efficacy of treatment or prevention of disease can be assessed, for example by measuring disease progression, disease remission, symptom severity, reduction in pain, quality of life, dose of a medication required to sustain a treatment effect, level of a disease marker, or any other measurable parameter appropriate for a given disease being treated or targeted for prevention. It is well within the ability of one skilled in the art to monitor efficacy of treatment or prevention by measuring any one of such parameters, or any combination of parameters. As discussed herein, the specific parameters to be measured depend on the HNF4α-associated disease that the subject is suffering from.

Comparisons of the later readings with the initial readings provide a physician an indication of whether the treatment is effective. It is well within the ability of one skilled in the art to monitor efficacy of treatment or prevention by measuring any one of such parameters, or any combination of parameters. In connection with the administration of an agent or composition, "effective against" a HNF4α-associated disorder indicates that administration in a clinically appropriate manner results in a beneficial effect for at least a statistically significant fraction of patients, such as a improvement of symptoms, a cure, a reduction in disease, extension of life, improvement in quality of life, or other effect generally recognized as positive by medical doctors familiar with treating HNF4α-associated disorders.

A treatment or preventive effect is evident when there is a statistically significant improvement in one or more parameters of disease status, or by a failure to worsen or to develop symptoms where they would otherwise be anticipated. As an example, a favorable change of at least 10% in a measurable parameter of disease, and preferably at least 20%, 30%, 40%, 50% or more can be indicative of effective treatment. Efficacy for a given agent or composition can also be judged using an experimental animal model for the given disease as known in the art. When using an experimental animal model, efficacy of treatment is evidenced when a statistically significant reduction in a marker or symptom is observed.

Alternatively, the efficacy can be measured by a reduction in the severity of disease as determined by one skilled in the art of diagnosis based on a clinically accepted disease severity grading scale. Any positive change resulting in e.g., lessening of severity of disease measured using the appropriate scale, represents adequate treatment using an agent or composition as described herein.

As used herein, the terms "treating" or "treatment" refer to a beneficial or desired result including, but not limited to, alleviation or amelioration of one or more signs or symptoms associated with HNF4α gene expression or HNF4α protein production. "Treatment" can also mean prolonging survival as compared to expected survival in the absence of treatment.

The present invention is next described by means of the following examples. However, the use of these and other examples anywhere in the specification is illustrative only, and in no way limits the scope and meaning of the invention or of any exemplified form. The invention is not limited to any particular preferred embodiments described herein. Many modifications and variations of the invention may be apparent to those skilled in the art and can be made without departing from its spirit and scope. The contents of all references, patents and published patent applications cited throughout this application, including the figures and informal sequence listing, are incorporated herein by reference.

EXAMPLES

Example 1. Modulation of HNF4α Expression

This example describes silencing of HNF4α expression with a site-specific HNF4α disrupting agent, comprising a site-specific HNF4α targeting moiety which targets an HNF4α expression control region, i.e., a guide RNA, and an effector comprising a fusion molecule comprising dCAS9 and KRAB.

Guide RNAs were designed to site-specifically target the transcriptional control region comprising promoter 1 (near the transcriptional start site) of the HNF4α gene (see, e.g., FIG. 1) and synthesized according to standard methods for oligonucleotide synthesis. The nucleotide sequences of the guide RNAs are provided in Table 2, below. Exemplary guide RNAs designed to site-specifically target the transcriptional control region comprising promoter 2 (near the transcriptional start site) of the HNF4α gene were also designed and are provided in Table 3, below. Additional exemplary guide RNAs designed to site-specifically target the transcriptional control region comprising promoter 2 (near the transcriptional start site) of the HNF4α gene were also designed and are provided in Table 9, below. Table 4, below, includes the unmodified nucleotide sequences, reverse complement nucleotide sequences, and chromosomal coordinates of the targeting portion of the guide RNAs in Tables 2 and 3.

HepG2 cells were seeded in 96-well plate (at a density of 3×10E4 cells/well) in appropriate media 24 hours prior to transfection. Cells were transfected with SSOP Lipid Nano-Particles (LNPs) containing mRNA encoding fusion proteins for dCAS9-KRAB (MR_28122) and guide RNAs (sgRNA) according to standard methods (see, e.g., Akita, et al. (*Advanced Healthcare Materials* (2013) 2:8.:1120-1125).

LNP formulations prepared using individual sgRNAs or Pools of sgRNAs (see, FIG. 1), were added to the cells for a final concentration of 5.0, 2.5, 1.25, or 0.625 µg/ml. The experiment was ended after 72 hours by lysing/freezing in RLT buffer for downstream mRNA purification or treatment with the Cell Titer Glo 2 reagent to quantify final cell number. qPCR was performed using HNF4α and ACTB probes to quantify relative HNF4α RNA transcription.

Figure 2:
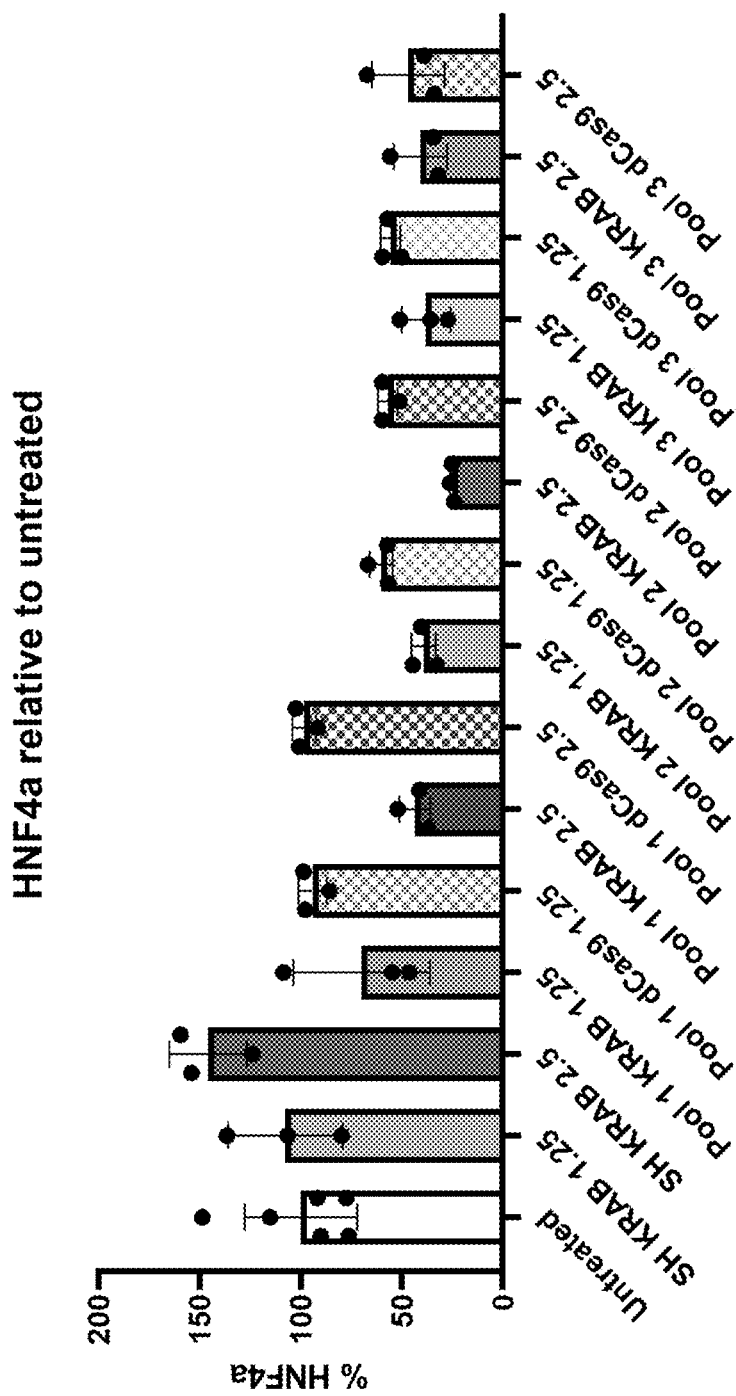
FIG. 2 is a graph depicting the percent of HNF4α mRNA remaining in HepG2 cells at 72 hours after contacting the cells with the indicated pools of site-specific HNF4α targeting moieties and an effector molecule comprising dCas and KRAB at the indicated doses.

FIG. 2 demonstrates that Pool 1 or Pool 2 guides in combination with the effector dCAS-KRAB inhibited HNF4α expression in a dose dependent manner relative to dCAS alone, SH-KRAB, and untreated. dCAS alone does affect transcription in some cases, and without wishing to be bound by theory, the inhibition may be the result of dCAS interference with polymerase binding.

Figure 3:
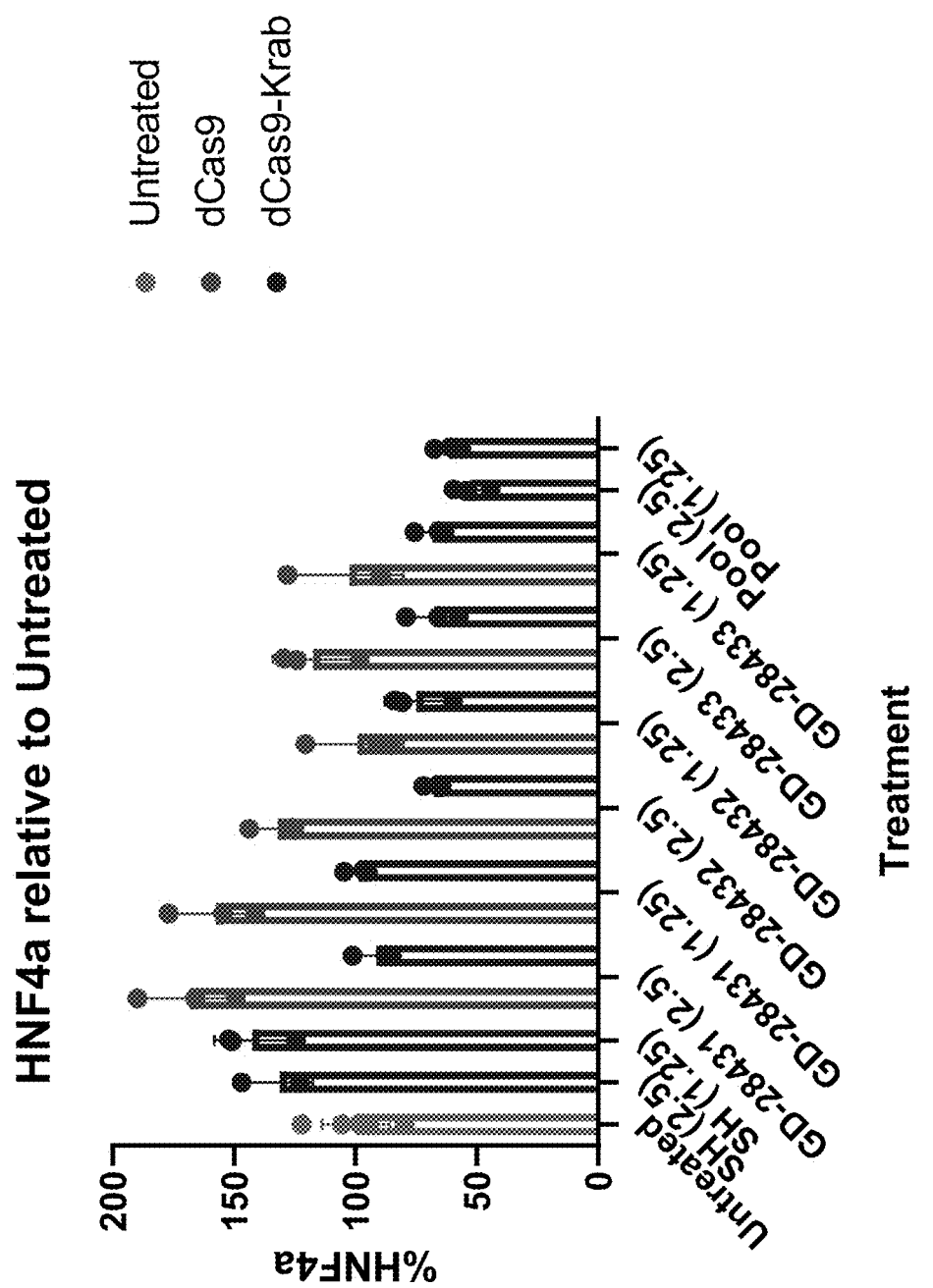
FIG. 3 is a graph depicting the percent of HNF4α mRNA remaining in HepG2 cells at 72 hours after contacting the cells with either the indicated site-specific HNF4α targeting moieties and an effector molecule comprising dCas and KRAB, or the indicated pools of HNF4α targeting moieties and an effector molecule comprising dCas and KRAB, at the indicated doses. Untreated cells and cells contacted with dCas9 alone were used as controls.

In addition, and as demonstrated in FIG. 3, Pool 1 at the highest concentration has the strongest silencing activity and guide RNAs GD-28432 and GD-28433 each have strong silencing activity alone, even at the lowest concentration.

Example 2. Modulation of HNF4α Expression

This example describes activation of HNF4α expression with a site-specific HNF4α disrupting agent, comprising a site-specific HNF4α targeting moiety which targets an HNF4α expression control region, i.e., a guide RNA, and an effector comprising a fusion molecule comprising dCAS9 (a non-editing Cas9 protein) and VPR.

Guide RNAs were designed to site-specifically target the transcriptional control region comprising promoter 1 (near the transcriptional start site) of the HNF4α gene (see, e.g., FIG. 1) and were synthesized according to standard methods for oligonucleotide synthesis. The nucleotide sequences of the guide RNAs are provided in Table 2, below. Exemplary guide RNAs designed to site-specifically target the transcriptional control region comprising promoter 2 (near the transcriptional start site) of the HNF4α gene were also designed and are provided in Table 3, below. Additional exemplary guide RNAs designed to site-specifically target the transcriptional control region comprising promoter 2 (near the transcriptional start site) of the HNF4α gene were also designed and are provided in Table 9, below. Table 4, below, includes the unmodified nucleotide sequences, reverse complement nucleotide sequences, and chromosomal coordinates of the guide RNAs in Tables 2 and 3.

LX-2, A549, and HepG2 cells were seeded in 96-well plates (at a density of 1×10E4 cells/well) in appropriate media 24 hours prior to transfection. LX-2 cells normally do not express HNF4α; HepG2 cells, liver cancer cell line cells, normally express more HNF4α that normal non-cancerous liver cells.

Cells were transfected with mRNA encoding fusion proteins for dCAS9-VPR (MR_28196) and guide RNAs (sgRNA). Individual sgRNAs or pools of sgRNAs were prepared using the Lipofectamine MessengerMAX Transfection protocol as described by the manufacturer. Untreated HepG2 cells were also included in the experiment as an internal control (comparator).

Briefly, 2.5 µl lipofectamine per lag of RNA was mixed with OptiMEM media and incubated for 10 minutes at room temperature (RT), and then added to cells in a 1:10 ratio of the media volume to the cells. Lipofectmine media mix was combined with RNA for a total volume of 120 µl at a final concentration of 100 µg/ml. This mix was incubated at RT for 5 minutes and added to the cells for a final concentration of 5.0, 2.5, 1.25, 0.625 µg/ml.

The experiment was ended after 48 hours by lysing/freezing in RLT buffer for downstream mRNA purification or treatment with the Cell Titer Glo 2 reagent to quantify final cell number. Briefly, the plate for RNA extraction was washed three times with PBS, following which 150 µL RLT buffer was added to each well. The plate was then frozen at −80° C. for later RNA processing. RNA was extracted following thawing of the plates, using the Qiagen RNeasy 96-well kit. RNA was quantified using Ribogreen. Reverse transcription and qPCR were carried out following the protocol for Absolute Quantitation for mRNA Expression by RT-qPCR.

The standard curves for HNF4α and β-actin (ACTB) were prepared as follows: HNF4α and ACTB gene block stocks (a synthesized reference copy of target cDNA) were prepared in nuclease-free water to a concentration of 10 mg/mL. A mixture 0.5 mg/mL of each gene block stock was prepared by combining 5 µL of each individual gene block stock and 40 µL H2O to a final volume of 50 uL. This mixture was then serially diluted (10-fold dilutions) 8 times. Two microliter (2 µL) of each standard curve dilution was used as the cDNA for the standard curve to which was added 8 µL of Taqman Master Mix with probes. The standard curve was set up in duplicate Wells were analyzed in technical triplicates.

RNA was extracted and HNF4α mRNA levels were determined by qPCR.

qPCR was performed using HNF4α and ACTB probes to quantify relative HNF4α RNA transcription. HepG2 HNF4α RNA expression was measured as a positive control.

Figures 4A, 4B:
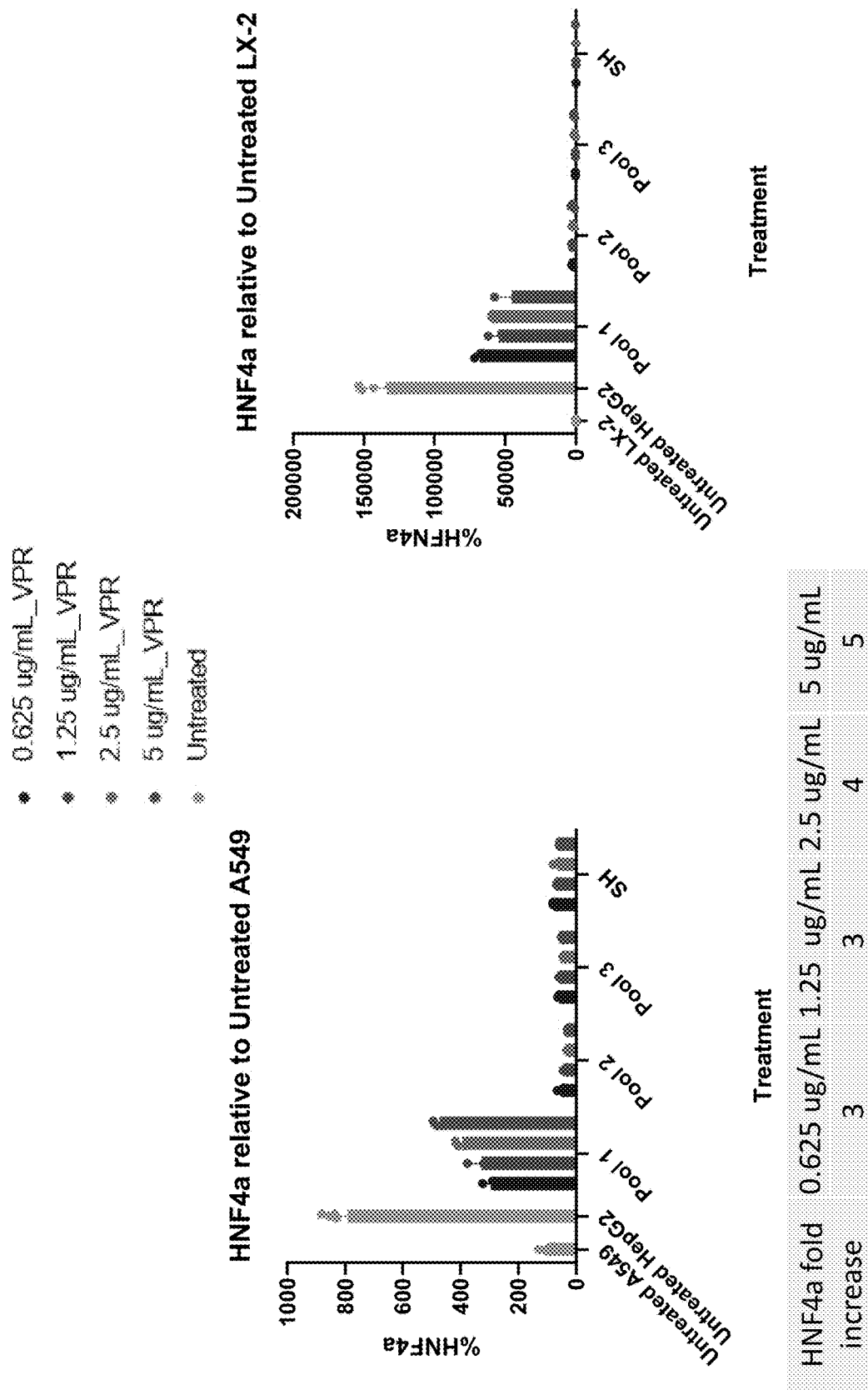
FIG. 4A is a graph depicting the percent of HNF4α mRNA measured in A549 cells at 48 hours after contacting the cells with the indicated pools of HNF4α targeting moieties and an effector molecule comprising dCas and VPR, at the indicated doses. SH is the abbreviation for "Safe Harbor" which is a non-target guide control.
FIG. 4B is a graph depicting the percent of HNF4α mRNA measured in LX-2 cells at 48 hours after contacting the cells with the indicated pools of HNF4α targeting moieties and an effector molecule comprising dCas and VPR at the indicated doses.

FIGS. 4A and 4B demonstrate that Pool 1 guides in combination with the effector dCAS-VPR show strong activation of HNF4α expression in both A549 cells and LX-2 cells in a dose dependent manner relative to SH-VPR, and untreated.

Delivering dCAS9-P300 using Lipofectamine MessengerMAX Transfection also upregulates HNF4α, but significantly less than dCAS-VPR (data not shown).

Similar experiments were conducted to evaluate the effect of dCas9 fusion proteins comprising dCas9-VPR and guides targeting the promoter region of HNF4α using Dlin-MC3-DMA (MC3), an LNP formulated for in vivo delivery. Using MC3-LNP, mRNA for dCas9-VPR and individual and pooled sgRNAs (Pool 1) were delivered to cells in culture. RNA was extracted and HNF4α mRNA levels were determined by qPCR as described above. Untreated HepG2 cells were included in the experiment as an internal control (comparitor).

Figure 5:
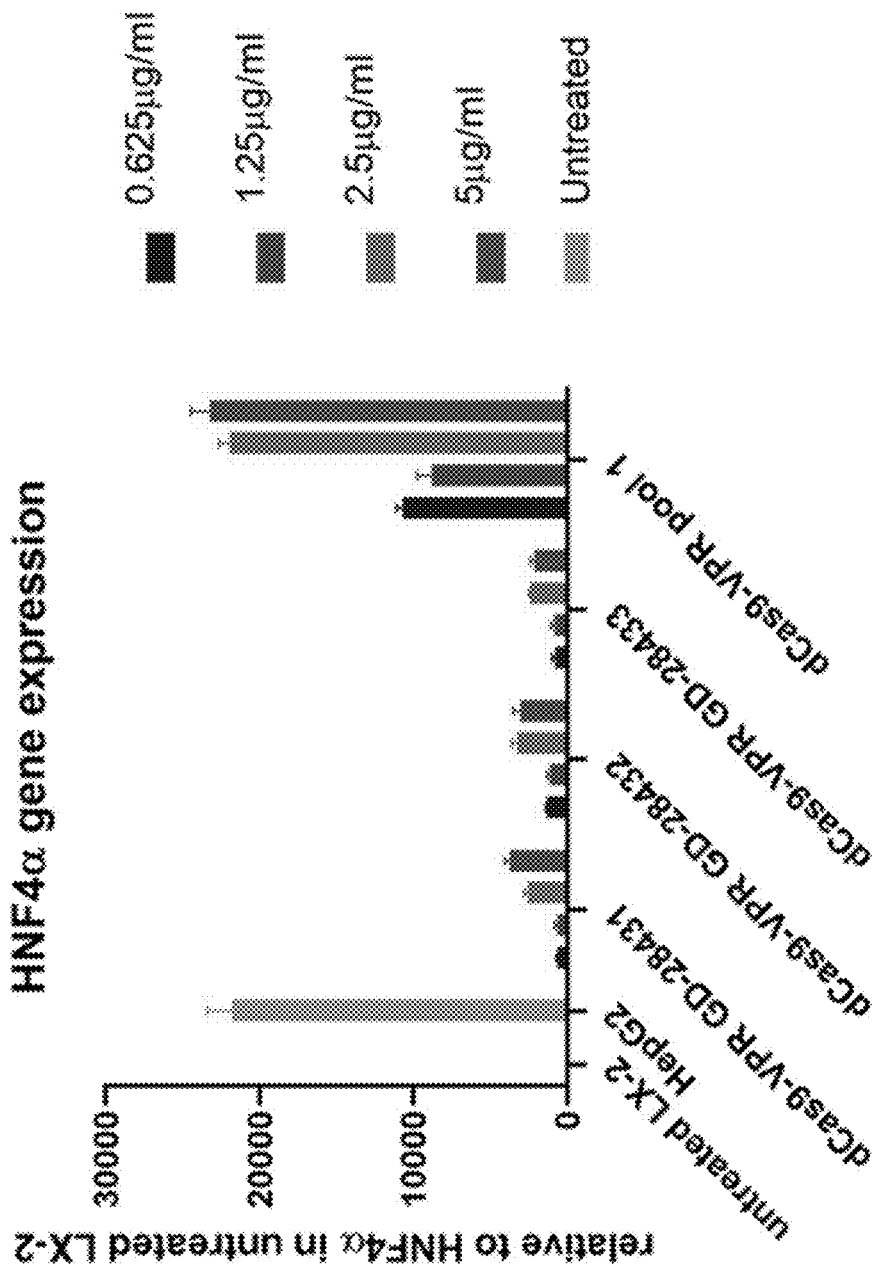
FIG. 5 is a graph depicting activation of HNF4α by dCas9-VPR in LX-2 cells with transfection using LNP formulations.

FIG. 5 demonstrates that, in this experiment, the MC3 LNPs are more efficient at transfecting LX-2 cells than Messenger Max in comparison to HNF4α levels to HepG2 (internal control). The individual sgRNAs targeting the HNF4α promoter show upregulation but significantly less than the pooled guides.

Activation of HNF4α in HepG2 Cells using MC3-LNP mediated delivery was also evaluated. HepG2 cells express a basal level of HNF4α that is higher than normal cells. Supraphysiological expression may facilitate greater durability of efficacy.

Using MC3-LNP, mRNA for dCas9-VPR and pooled sgRNAs were delivered to HepG2 cells in culture. A dCas9-VPR control with a control, SH (safe harbor non-targeting control) guide, was also included. HNF4α mRNA levels were determined by qPCR.

Figure 6:
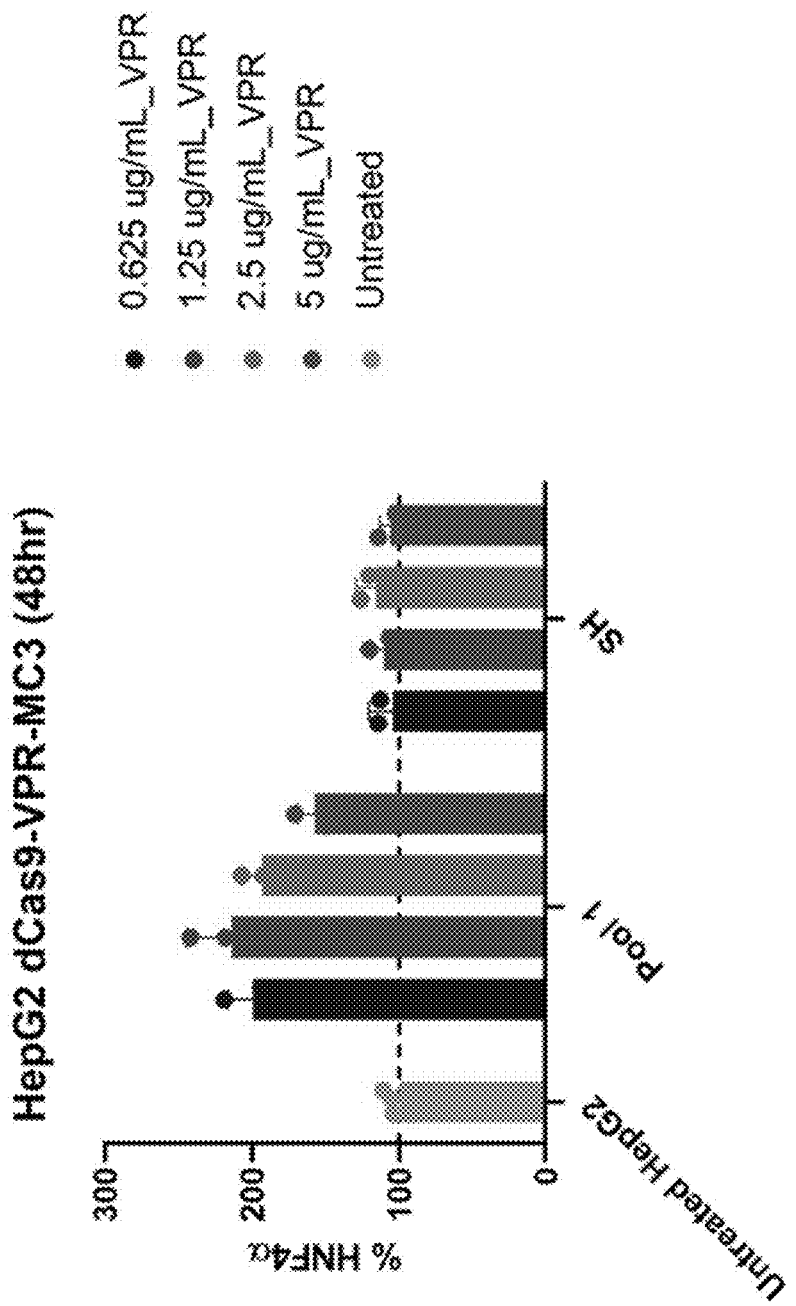
FIG. 6 is a graph depicting activation of HNF4 α by dCas9-VPR in HepG2 cells with transfection using LNP formulations.

FIG. 6 demonstrates that MC3-LNP formulations induced over-expression of HNF4α in HepG2 cells. Expression levels of up to about 200% of control levels were observed. Such expression level were tolerated in cells in culture. The result of the SH control demonstrates that upregulation of HNF4α is specifically due to the promoter targeted delivery of the activating effector.

To investigate whether the HNF4α protein induced by dCas9-VPR Pool 1 was localized to the nucleus of the cell, LX-2 cells were transfected with mRNA for dCas9-VPR and and pooled sgRNAs (Pool 1). In order to visualize cells, treated LX-2 cells were fixed and permeabilized. Cells were grown in 96 well plates with black walls and a clear bottom. Media was removed. All incubations were at room temperature (RT) and stationary. All solutions were made with 10×PBS stock solution. Media was removed and cells were washed 2 times with 1×PBS. To wash the cells, 100 µl of 1×PBS was added, and removed. The wash was repeated twice. One hundred microliter (100 µl) of 4% PFA in 1×PBS was added and incubated for 15 minutes at RT. Cells were washed 3 times with 1×PBS, with 5 minutes incubation between each wash. Cells were then incubated in 100 µl of 0.1% Triton $X_{100}$ in 1×PBS for 15 minutes at RT. One hundred microliter (100 µl) of 10% normal goat serum in 1×PBS with 0.1% Triton $X_{100}$ was added and kept at 4 C until further use.

Figure 7:
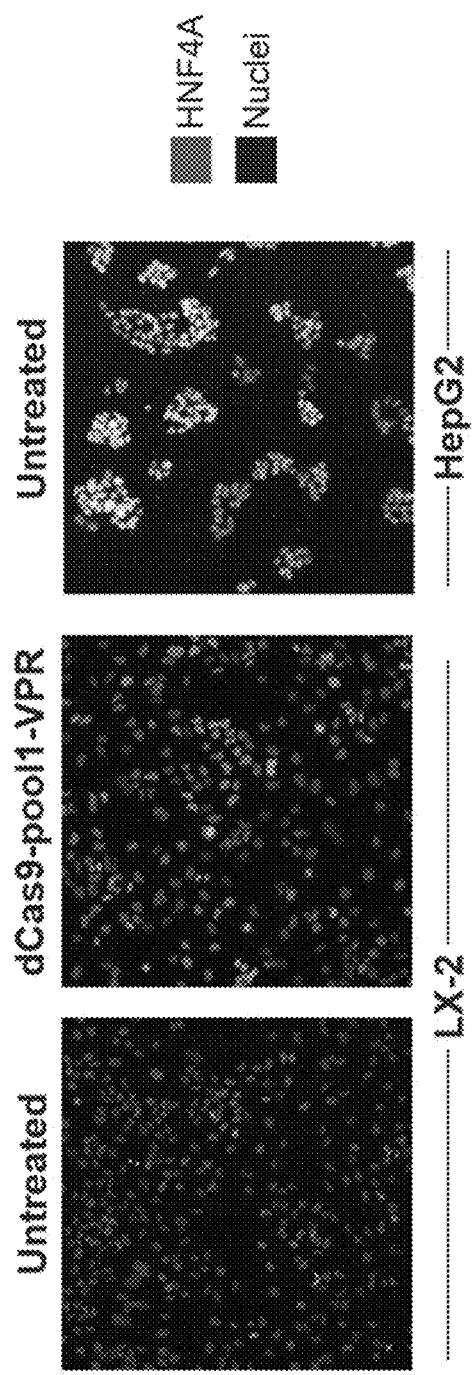
FIG. 7 are immunohistological images depicting that HNF4α protein induced by dCas9-VPR Pool 1 is localized to the nucleus.

The fixed and permeabilized cells were stained with anti-HNF4α antibody and DAPI. FIG. 7 shows that the HNF4α protein induced by dCas9-VPR Pool 1 can be detected and travels to the nucleus.

TABLE 2

Site-Specific HNF4α Promoter 1 Targeting Moieties (sgRNA)- The first 20 nucleotides in each moiety below comprise the targeting portion of the moiety.

| Identifier | SEQ ID NO. | Modified Nucleotide Sequence 5' to 3' |
|---|---|---|
| GD-28431 | 68 | mAs; mUs; mUs; rG; rA; rA; rU; rU; rA; rG; rG; rG; rA; rU; rC; rU; rC; rG; rG; rG; rU; rU; rU; rU; rA; rG; rA; rG; rC; rU; rA; rG; rA; rA; rU; rA; rG; rC; rA; rA; rG; rU; rU; rA; rA; rA; rU; rA; rA; rG; rC; rU; rA; rG; rU; rC; rC; rG; rU; rU; rA; rU; rC; rA; rA; rC; rU; rU; rG; rA; rA; rA; rA; rG; rU; rG; rG; rC; rA; rC; rC; rG; rA; rG; rU; rC; rG; rG; rU; rG; rC; rUs; mUs; mUs; mU |
| GD-28432 | 69 | mGs; mAs; mCs; rU; rU; rG; rG; rG; rG; rU; rG; rA; rC; rA; rA; rU; rG; rG; rC; rU; rG; rU; rU; rU; rU; rA; rG; rA; rG; rC; rU; rA; rG; rA; rA; rA; rU; rA; rG; rC; rA; rA; rG; rU; rU; rA; rA; rA; rA; rU; rA; rA; rG; rG; rC; rU; rA; rG; rU; rC; rC; rG; rU; rU; rA; rU; rC; rA; rA; rC; rU; rU; rG; rA; rA; rA; rA; rA; rG; rU; rG; rG; rC; rA; rC; rC; rG; rA; rG; rU; rC; rG; rG; rU; rG; rC; rUs; mUs; mUs; mU |
| GD-28433 | 70 | mAs; mAs; mCs; rU; rG; rA; rA; rC; rA; rU; rC; rG; rG; rU; rG; rA; rG; rU; rU; rA; rG; rU; rU; rU; rU; rA; rG; rA; rG; rC; rU; rA; rG; rA; rA; rA; rU; rA; rG; rC; rA; rA; rG; rU; rU; rA; rA; rA; rA; rU; rA; rA; rG; rG; rC; rU; rA; rG; rU; rC; rC; rG; rU; rU; rA; rU; rC; rA; rA; rC; rU; rU; rG; rA; rA; rA; rA; rA; rG; rU; rG; rG; rC; rA; rC; rC; rG; rA; rG; rU; rC; rG; rG; rU; rG; rC; rUs; mUs; mUs; mU |
| GD-28434 | 71 | mUs; mGs; mGs; rU; rU; rU; rC; rU; rG; rG; rC; rU; rG; rA; rC; rA; rC; rC; rC; rG; rG; rU; rU; rU; rU; rA; rG; rA; rG; rC; rU; rA; rG; rA; rA; rA; rU; rA; rG; rC; rA; rA; rG; rU; rU; rA; rA; rA; rA; rU; rA; rA; rG; rG; rC; rU; rA; rG; rU; rC; rC; rG; rU; rU; rA; rU; rC; rA; rA; rC; rU; rU; rG; rA; rA; rA; rA; rA; rG; rU; rG; rG; rC; rA; rC; rC; rG; rA; rG; rU; rC; rG; rG; rU; rG; rC; rUs; mUs; mUs; mU |
| GD-28435 | 72 | mAs; mUs; mGs; rG; rU; rU; rA; rA; rU; rC; rG; rG; rU; rC; rC; rC; rC; rG; rC; rC; rG; rU; rU; rU; rU; rA; rG; rA; rG; rC; rU; rA; rG; rA; rA; rA; rU; rA; rG; rC; rA; rA; rG; rU; rU; rA; rA; rA; rA; rU; rA; rA; rG; rG; rC; rU; rA; rG; rU; rC; rC; rG; rU; rU; rA; rU; rC; rA; rA; rC; rU; rU; rG; rA; rA; rA; rA; rA; rG; rU; rG; rG; rC; rA; rC; rC; rG; rA; rG; rU; rC; rG; rG; rU; rG; rC; rUs; mUs; mUs; mU |
| GD-28436 | 73 | mGs; mUs; mCs; rC; rU; rC; rU; rG; rG; rA; rA; rG; rA; rU; rC; rU; rG; rC; rU; rG; rU; rU; rU; rU; rA; rG; rA; rG; rC; rU; rA; rG; rA; rA; rA; rU; rA; rG; rC; rA; rA; rG; rU; rU; rA; rA; rA; rA; rU; rA; rA; rG; rG; rC; rU; rA; rG; rU; rC; rC; rG; rU; rU; rA; rU; rC; rA; rA; rC; rU; rU; rG; rA; rA; rA; rA; rA; rG; rU; rG; rG; rC; rA; rC; rC; rG; rA; rG; rU; rC; rG; rG; rU; rG; rC; rUs; mUs; mUs; mU |
| GD-28437 | 74 | mGs; mGs; mUs; rU; rU; rG; rA; rA; rA; rG; rG; rA; rA; rG; rG; rC; rA; rG; rA; rG; rG; rU; rU; rU; rU; rA; rG; rA; rG; rC; rU; rA; rG; rA; rA; rA; rU; rA; rG; rC; rA; rA; rG; rU; rU; rA; rA; rA; rA; rU; rA; rA; rG; rG; rC; rU; rA; rG; rU; rC; rC; rG; rU; rU; rA; rU; rC; rA; rA; rC; rU; rU; rG; rA; rA; rA; rA; rA; rG; rU; rG; rG; rC; rA; rC; rC; rG; rA; rG; rU; rC; rG; rG; rU; rG; rC; rUs; mUs; mUs; mU |
| GD-28438 | 75 | mAs; mCs; mCs; rC; rU; rG; rG; rG; rC; rG; rC; rC; rC; rA; rC; rC; rC; rG; rA; rG; rU; rU; rU; rU; rA; rG; rA; rG; rC; rU; rA; rG; rA; rA; rA; rU; rA; rG; rC; rA; rA; rG; rU; rU; rA; rA; rA; rA; rU; rA; rA; rG; rG; rC; rU; rA; rG; rU; rC; rC; rG; rU; rU; rA; rU; rC; rA; rA; rC; rU; rU; rG; rA; rA; rA; rA; rA; rG; rU; rG; rG; rC; rA; rC; rC; rG; rA; rG; rU; rC; rG; rG; rU; rG; rC; rUs; mUs; mUs; mU |
| GD-28439 | 76 | mUs; mUs; mCs; rU; rC; rC; rU; rG; rC; rC; rU; rC; rC; rA; rC; rG; rC; rG; rG; rU; rU; rU; rU; rA; rG; rA; rG; rC; rU; rA; rG; rA; rA; rA; rU; rA; rG; rC; rA; rA; rG; rU; rU; rA; rA; rA; rA; rU; rA; rA; rG; rG; rC; rU; rA; rG; rU; rC; rC; rG; rU; rU; rA; rU; rC; rA; rA; rC; rU; rU; rG; rA; rA; rA; rA; rA; rG; rU; rG; rG; rC; rA; rC; rC; rG; rA; rG; rU; rC; rG; rG; rU; rG; rC; rUs; mUs; mUs; mU |

TABLE 3

Site-Specific HNF4α Promoter 2 Targeting Moieties (sgRNA) - The first 20 nucleotides in each moiety below comprise the targeting portion of the moiety.

| Identifier | SEQ ID NO. | Modified Nucleotide Sequence 5' to 3' |
|---|---|---|
| GD28427 | 77 | mAs; mUs; mGs; rC; rC; rC; rC; rC; rA; rG; rC; rU; rC; rU; rC; rC; rG; rG; rC; rU; rG; rU; rU; rU; rU; rA; rG; rA; rG; rC; rU; rA; rG; rA; rA; rA; rU; rA; rG; rC; rA; rA; rG; rU; rU; rA; rA; rA; rA; rU; rA; rA; rG; rG; rC; rU; rA; rG; rU; rC; rC; rG; rU; rU; rA; rU; rC; rA; rA; rC; rU; rU; rG; rA; rA; rA; rA; rA; rG; rU; rG; rG; rC; rA; rC; rC; rG; rA; rG; rU; rC; rG; rG; rU; rG; rC; rUs; mUs; mUs; mU |

TABLE 3-continued

Site-Specific HNF4α Promoter 2 Targeting Moieties (sgRNA) - The first 20
nucleotides in each moiety below comprise the targeting portion of the moiety.

| Identifier | SEQ ID NO. | Modified Nucleotide Sequence 5' to 3' |
|---|---|---|
| GD28428 | 78 | mCs; mAs; mGs; rC; rG; rU; rG; rA; rA; rC; rG; rC; rG; rC; rC; rC; rC; rU; rC; rG; rG; rU; rU; rU; rU; rA; rG; rA; rG; rC; rU; rA; rG; rA; rA; rA; rU; rA; rG; rC; rA; rA; rG; rU; rU; rA; rA; rA; rA; rU; rA; rG; rG; rC; rU; rA; rG; rU; rC; rC; rG; rU; rU; rA; rU; rC; rA; rA; rC; rU; rU; rG; rA; rA; rA; rA; rA; rG; rU; rG; rG; rC; rA; rC; rC; rG; rA; rG; rU; rC; rG; rG; rU; rG; rC; rUs; mUs; mUs; mU |
| GD28429 | 79 | mCs; mUs; mUs; rA; rC; rG; rG; rU; rA; rA; rG; rU; rG; rG; rG; rG; rC; rU; rG; rG; rG; rU; rU; rU; rU; rA; rG; rA; rG; rC; rU; rA; rG; rA; rA; rA; rU; rA; rG; rC; rA; rA; rG; rU; rU; rA; rA; rA; rA; rU; rA; rA; rG; rG; rC; rU; rA; rG; rU; rC; rC; rG; rU; rU; rA; rU; rC; rA; rA; rC; rU; rU; rG; rA; rA; rA; rA; rA; rG; rU; rG; rG; rC; rA; rC; rC; rG; rA; rG; rU; rC; rG; rG; rU; rG; rC; rUs; mUs; mUs; mU |
| GD28430 | 80 | mCs; mCs; mCs; rG; rU; rA; rA; rG; rA; rA; rC; rA; rC; rA; rC; rG; rG; rG; rG; rU; rU; rU; rU; rA; rG; rA; rG; rC; rU; rA; rG; rA; rA; rA; rU; rA; rG; rC; rA; rA; rG; rU; rU; rA; rA; rA; rA; rU; rA; rA; rG; rG; rC; rU; rA; rG; rU; rC; rC; rG; rU; rU; rA; rU; rC; rA; rA; rC; rU; rU; rG; rA; rA; rA; rA; rA; rG; rU; rG; rG; rC; rA; rC; rC; rG; rA; rG; rU; rC; rG; rG; rU; rG; rC; rUs; mUs; mUs; mU |
| GD28431 | 68 | mAs; mUs; mUs; rG; rA; rA; rU; rU; rA; rG; rG; rG; rG; rA; rU; rC; rU; rC; rG; rG; rG; rU; rU; rU; rU; rA; rG; rA; rG; rC; rU; rA; rG; rA; rA; rA; rU; rA; rG; rC; rA; rA; rG; rU; rU; rA; rA; rA; rA; rU; rA; rA; rG; rG; rC; rU; rA; rG; rU; rC; rC; rG; rU; rU; rA; rU; rC; rA; rA; rC; rU; rU; rG; rA; rA; rA; rA; rA; rG; rU; rG; rG; rC; rA; rC; rC; rG; rA; rG; rU; rC; rG; rG; rU; rG; rC; rUs; mUs; mUs; mU |

TABLE 4

Unmodified Nucleotide Sequences of the Targeting Portion of the Site-Specific HNF4α
Targeting Moieties in Tables 2 and 3.

| Identifier | SEQ ID NO. | Unmodified Nucleotide Sequence 5' to 3' | SEQ ID NO. | Reverse Complement Nucleotide Sequence 5' to 3' | Chromosomal Coordinates |
|---|---|---|---|---|---|
| GD-28427 | 329 | ATGCCCCCAGCTCTCCGGCT | 335 | AGCCGGAGAGCTGGGGGCAT | chr20: 42984411-42984433 |
| GD-28428 | 330 | CAGCGTGAACGCGCCCCTCG | 336 | CGAGGGGCGCGTTCACGCTG | chr20: 42984450-42984472 |
| GD-28429 | 331 | CTTACGGTAAGTGGGGCTGG | 337 | CCAGCCCCACTTACCGTAAG | chr20: 42984488-42984510 |
| GD-28430 | 332 | CCCGTAAGAAACACACGGGG | 338 | CCCCGTGTGTTTCTTACGGG | chr20: 42984560-42984582 |
| GD-28431 | 333 | ATTGAATTAGGGGATCTCGG | 339 | CCGAGATCCCCTAATTCAAT | chr20: 43029535-43029557 |
| GD-28432 | 334 | GACTTGGGGTGACAATGGCT | 340 | AGCCATTGTCACCCCAAGTC | chr20: 43029596-43029618 |
| GD-28433 | 81 | AACTGAACATCGGTGAGTTA | 82 | TAACTCACCGATGTTCAGTT | chr20: 43029685-43029707 |
| GD-28434 | 83 | TGGTTTCTGGCTGACACCCG | 84 | CGGGTGTCAGCCAGAAACCA | chr20: 43029729-43029751 |
| GD-28435 | 85 | ATGGTTAATCGGTCCCCCGC | 86 | GCGGGGGACCGATTAACCAT | chr20: 43029792-43029814 |
| GD-28436 | 87 | GTCCTCTGGGAAGATCTGCT | 88 | AGCAGATCTTCCCAGAGGAC | chr20: 43029873-43029895 |

TABLE 4-continued

Unmodified Nucleotide Sequences of the Targeting Portion of the Site-Specific HNF4α Targeting Moieties in Tables 2 and 3.

| Identifier | SEQ ID NO. | Unmodified Nucleotide Sequence 5' to 3' | SEQ ID NO. | Reverse Complement Nucleotide Sequence 5' to 3' | Chromosomal Coordinates |
|---|---|---|---|---|---|
| GD-28437 | 89 | GGTTTGAAAGGAAGGCAGAG | 90 | CTCTGCCTTCCTTTCAAACC | chr20: 43029896-43029918 |
| GD-28438 | 91 | ACCCTGGGCGCCCACCCCGA | 92 | TCGGGGTGGGCGCCCAGGGT | chr20: 43029957-43029979 |
| GD-28439 | 93 | TTCTCCCTGCCTCCACGCCG | 94 | CGGCGTGGAGGCAGGGAGAA | chr20: 43029991-43030013 |

TABLE 5

Abbreviations of nucleotide monomers used in nucleic acid sequence representation. It will be understood that these monomers, when present in an oligonucleotide, are mutually linked by 5'-3'- phosphodiester bonds.

| Abbreviation | Nucleotide(s) |
|---|---|
| A | Adenosine-3'-phosphate |
| As | adenosine-3'-phosphorothioate |
| C | cytidine-3'-phosphate |
| Cs | cytidine-3'-phosphorothioate |
| G | guanosine-3'-phosphate |
| Gs | guanosine-3'-phosphorothioate |
| U | Uridine-3'-phosphate |
| Us | uridine-3'-phosphorothioate |
| N | any nucleotide, modified or unmodified |
| mA | 2'-O-methyladenosine-3'-phosphate |
| mAs | 2'-O-methyladenosine-3'-phosphorothioate |
| mC | 2'-O-methylcytidine-3'-phosphate |
| mCs | 2'-O-methylcytidine-3'- phosphorothioate |
| mG | 2'-O-methylguanosine-3'-phosphate |
| mGs | 2'-O-methylguanosine-3'- phosphorothioate |
| mU | 2'-O-methyluridine-3'-phosphate |
| mUs | 2'-O-methyluridine-3'-phosphorothioate |
| s | phosphorothioate linkage |
| r | ribonucleotide |

Example 3. Design of Zinc Finger DNA Binding Domain and TALE Fusion Protein

Figure 9:
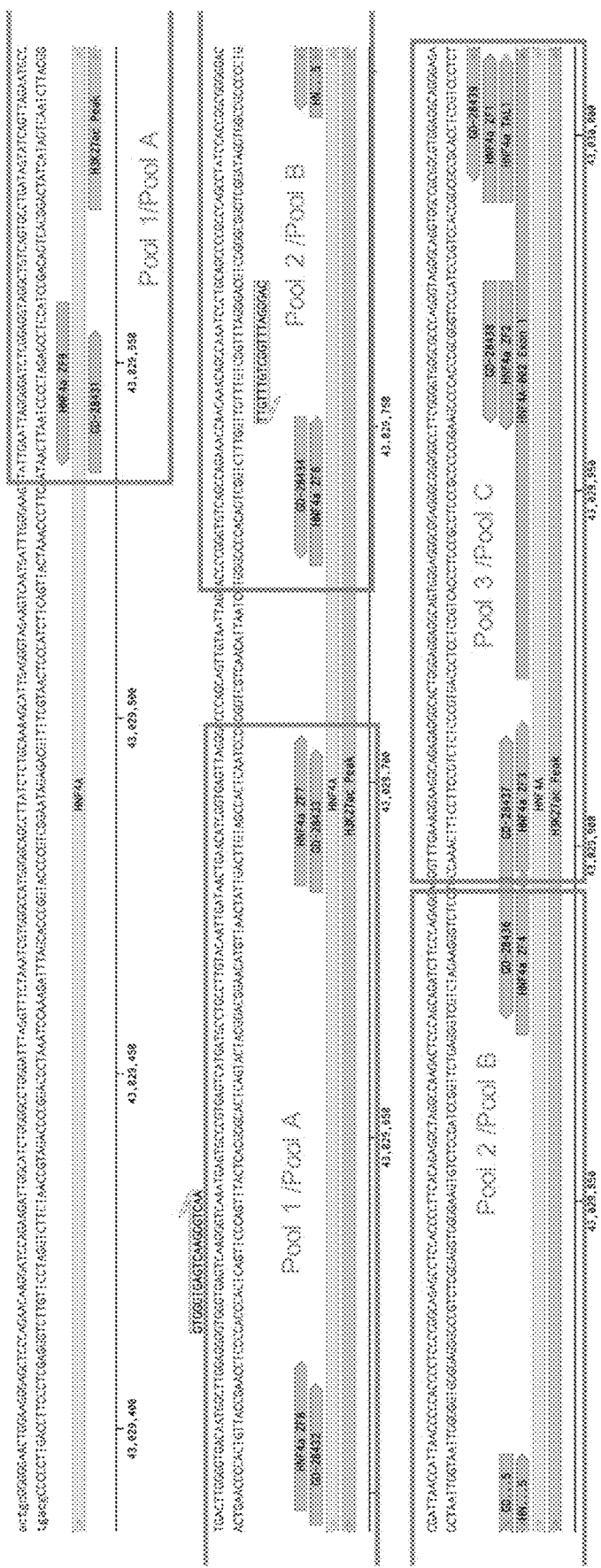
FIG. 9 schematically depicts the localization to the HNF4α promoter region of the various site-specific HNF4α targeting moieties.

As described in Examples 1 and 2, the sites of effective activation of HNF4α gene expression were identified using dCas9 fusion proteins and guides directed to specific nucleotide regions 5' of promoter 1 of the HNF4α gene. Based on these data, Zinc Finger DNA binding domain polypeptides (ZF) and TALE polypeptides were designed to target the same or similar sequence regions 5' of promoter 1 of the HNF4α gene. FIG. 9 depicts the target areas for design of the exemplary ZF proteins and TALE proteins of the inventions.

Figure 10:
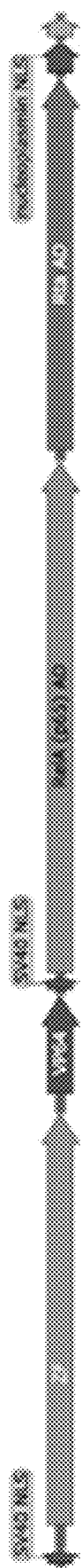
FIG. 10 schematically depicts the structure of an exemplary zinc finger-VPR fusion protein of the invention.

FIG. 10 depicts the structure of the exemplary site-specific HNF4α disrupting agent, comprising a site-specific HNF4α targeting moiety which targets an HNF4α expression control region, e.g., a zing finger (ZF) or a TALE, and an effector comprising, e.g., VPR (e.g., ZF-VPR or TALE-VPR fusion proteins) of the invention. As shown in FIG. 10, an exemplary ZF-VPR protein may include one or more nuclear localization signals (NLS), such as SV40 NLS or nucleoplasmin NLS. In some embodiments, the NLSs are located at the N-terminus, between the VP64 and RelA (p65) activiation domain (VPR), and at the C-terminus.

In some embodiments, the mRNAs encoding the ZF fusion protein or the TAL fusion proteins, may contain a "natural cap" structure at the 5'-terminus, e.g., the mRNAs may be cap0 (no methyl), cap1 (methyl on first ribose), cap2 (methyl on second ribose).

Downstream of the cap is a 5' untranslated region (UTR), a sequence which is designed to promote high levels of protein translation. Downstream of the 5' UTR is the coding sequence, 3' UTR and the polyA tail.

An exemplary nucleotide sequence of a 5' UTR for use in the constructs is (SEQ ID NO.: 341)
AGGAAAUAAGAGAGAAAAGAAGAGUAAGAAGAAAUAUAAGAGCCACC.

An exemplary nucleotide sequence of a 3' UTR for use in the constructs is (SEQ ID NO.: 342)
CUCUCCCUUGCACCUGUACCUCUUGGUCUUUGAAUAAAGCCUGAGUAGGA

AGUCUAG

An exemplary nucleotide sequence of a poly-A tail for use in the constructs is (SEQ ID NO.: 343)
AAAAAAAAAAAAAAAAAAAAAAAAAAAAAAAAAAAAAAAAAAAAAAAAAA

AAAAAAAAAAAAAAAAAAAAAAAAA

The mRNAs encoding the ZF fusion proteins or the TALE fusion proteins may be complexed with a lipid nanoparticle (e.g., MC3). The ZF domains of the fusion proteins are targeted to P1 of HNF4α, which controls the transcription of the isoforms of HNF4α expressed primarily in the liver.

Tables 6A and 6B below provide the amino acid sequences of various exemplary fusion protein constructs, the corresponding encoding mRNA sequences, the target genomic sequences thereof, and the amino acid sequences of the DNA binding domains for use in the disrupting agents of the constructs.

TABLE 6A

| Column 1 Exemplary HNF4α Disrupting Agents Comprising a Zinc Finger DNA Binding Domain and an Effector Name | Column 2 Amino Acid Sequence of the Disrupting Agent in Column 1 (SEQ ID NO:) | Column 3 Nucleotide Sequence of the Disrupting Agents in Column 1 (SEQ ID NO). | Column 4 Sequence of Target Site in HNF4α Expression Control Region Targeted by the Disrupting Agents in Column 1 (SEQ ID NO.) | Column 5 Amino Acid Sequence of the DNA Binding Domain of the Disrupting Agent in Column 1 (SEQ ID NO.) | Column 6 Nucleotide Sequence of the DNA Binding Domain of the Disrupting Agent in Column 1 (SEQ ID NO.) | Column 7 Genomic Coordinates of the Target Site in the HNF4α Expression Control Region (Genome Reference Consortium Human Build 37 (GRCh37): Chromosome 20) |
|---|---|---|---|---|---|---|
| ZF1-VPR | 100 | 101 | 102 | 103 | 211 | GrCh37: chr20:43029991-43030011 |
| ZF2-VPR | 104 | 105 | 106 | 107 | 212 | GrCh37: chr20:43029959-43029979 |
| ZF3-VPR | 108 | 109 | 110 | 111 | 213 | GrCh37: chr20:43029897-43029917 |
| ZF4-VPR | 112 | 113 | 114 | 115 | 214 | GrCh37: chr20:43029874-43029894 |
| ZF5-VPR | 116 | 117 | 118 | 119 | 215 | GRCh37: chr20:43029794-43029814 |
| ZF6-VPR | 120 | 121 | 122 | 123 | 216 | CRCh37: chr20:43029731-43029751 |
| ZF7-VPR | 124 | 125 | 126 | 127 | 217 | GRCh37: chr20:43029686-43029706 |
| ZF8-VPR | 128 | 129 | 130 | 131 | 218 | GrCh37: chr20:43029598-43029618 |
| ZF9-VPR | 132 | 133 | 134 | 135 | 219 | GrCh37: chr20:43029536-43029558 |
| ZF10-VPR | 136 | 137 | 138 | 139 | 220 | GrCh37: chr20:43029767-43029787 |
| ZF11-VPR | 140 | 141 | 142 | 143 | 221 | GrCh37: chr20:43029820-43029840 |
| ZF12-VPR | 144 | 145 | 146 | 147 | 222 | GrCh37: chr20:43029855-43029875 |
| ZF13-VPR | 148 | 149 | 150 | 151 | 223 | GrCh37: chr20:43029766-43029786 |
| ZF14-VPR | 152 | 153 | 154 | 155 | 224 | GRCh37: chr20:43029810-43029830 |
| ZF15-VPR | 156 | 157 | 158 | 159 | 225 | GRCh37: chr20:43029832-43029852 |
| ZF5-VPR ATUM Opt_1 (ZF5.1-VPR) | 116 | 160 | 118 | 119 | 226 | GRCh37: chr20:43029794-43029814 |
| ZF5-VPR ATUM Opt_2 (ZF5.2-VPR) | 116 | 161 | 118 | 119 | 227 | GRCh37: chr20:43029794-43029814 |
| ZF5-VPR ATUM Opt_3 (ZF5.3-VPR) | 116 | 162 | 118 | 119 | 228 | GRCh37: chr20:43029794-43029814 |
| ZF5-VPR ATUM Opt_4 (ZF5.4-VPR) | 116 | 163 | 118 | 119 | 229 | GRCh37: chr20:43029794-43029814 |
| ZF5-VPR ATUM Opt_5 (ZF5.5-VPR) | 116 | 164 | 118 | 119 | 230 | GRCh37: chr20:43029794-43029814 |
| ZF5-VPR ATUM Opt_6 (ZF5.6-VPR) | 116 | 165 | 118 | 119 | 231 | GRCh37: chr20:43029794-43029814 |
| ZF5-P300 | 166 | 167 | 118 | 119 | 232 | GRCh37: chr20:43029794-43029814 |
| ZF5-VPR + ZF7-VPR | 116 + 124 | 117 + 125 | 118 + 126 | 119 + 127 | 215 + 217 | GRCh37: chr20:43029794-43029814 GRCh37: chr20:43029686-43029706 |
| ZF5-VPR ATUMOpt_3 + ZF7-VPR | 116 + 124 | 162 + 125 | 118 + 126 | 119 + 127 | 228 + 217 | GRCh37: chr20:43029794-43029814 GRCh37: chr20:43029686-43029706 |
| ZF7-P300 | 168 | 169 | 126 | 127 | 233 | GRCh37: chr20:43029686-43029706 |
| ZF5.3-VPR3 | 170 | 171 | 118 | 119 | 234 | GRCh37: chr20:43029794-43029814 |
| ZF5-no effector | 174 | 175 | 118 | 119 | 235 | GRCh37: chr20:43029794-43029814 |
| ZF5.3-VPR-tPT2a-ZF7-VPR | 176 | 177 | 118 + 126 | 119 + 127 | 236 + 237 | GRCh37: chr20:43029794-43029814 GRCh37: chr20:43029686-43029706 |
| ZF7-VPR-tPT2a-ZF5.3-VPR | 178 | 179 | 126 + 118 | 127 + 119 | 238 + 239 | GRCh37: chr20:43029686-43029706 GRCh37: chr20:43029794-43029814 |

TABLE 6A-continued

| Column 1 Exemplary HNF4α Disrupting Agents Comprising a Zinc Finger DNA Binding Domain and an Effector Name | Column 2 Amino Acid Sequence of the Disrupting Agent in Column 1 (SEQ ID NO:) | Column 3 Nucleotide Sequence of the Disrupting Agents in Column 1 (SEQ ID NO). | Column 4 Sequence of Target Site in HNF4α Expression Control Region Targeted by the Disrupting Agents in Column 1 (SEQ ID NO.) | Column 5 Amino Acid Sequence of the DNA Binding Domain of the Disrupting Agent in Column 1 (SEQ ID NO.) | Column 6 Nucleotide Sequence of the DNA Binding Domain of the Disrupting Agent in Column 1 (SEQ ID NO.) | Column 7 Genomic Coordinates of the Target Site in the HNF4α Expression Control Region (Genome Reference Consortium Human Build 37 (GRCh37): Chromosome 20) |
|---|---|---|---|---|---|---|
| ZF5.3-VPR-tPT2a-ZF7-p300 | 180 | 181 | 118 + 126 | 119 + 127 | 240 + 241 | GRCh37: chr20:43029794-43029814<br>GRCh37: chr20:43029686-43029706 |
| ZF7-p300-tPT2a-ZF5.3-VPR | 182 | 183 | 126 + 118 | 127 + 119 | 242 + 243 | GRCh37: chr20:43029686-43029706<br>GRCh37: chr20:43029794-43029814 |
| TAL1-VPR | 184 | 185 | 102 | 186 | 244 | GrCh37: chr20:43029991-43030011 |
| TAL2-VPR | 187 | 188 | 106 | 189 | 245 | GrCh37: chr20:43029959-43029979 |
| TAL3-VPR | 190 | 191 | 110 | 192 | 246 | GrCh37: chr20:43029897-43029917 |
| TAL4-VPR | 193 | 194 | 114 | 195 | 247 | GrCh37: chr20:43029874-43029894 |
| TAL5-VPR | 196 | 197 | 118 | 198 | 248 | GRCh37: chr20:43029794-43029814 |
| TAL6-VPR | 199 | 200 | 122 | 201 | 249 | CRCh37: chr20:43029731-43029751 |
| TAL7-VPR | 202 | 203 | 126 | 204 | 250 | GRCh37: chr20:43029686-43029706 |
| TAL8-VPR | 205 | 206 | 130 | 207 | 251 | GrCh37: chr20:43029598-43029618 |
| TAL9-VPR | 208 | 209 | 134 | 210 | 252 | GrCh37: chr20:43029536-43029558 |

TABLE 6B

| Column 1 Exemplary Effector Fusion Protein of Exemplary HNF4α Disrupting Agents Name | Column 2 Amino acid sequence of the Effector Fusion Protein in Column 1 (SEQ ID NO:) | Column 3 Nucleotide sequence of the Effector Fusion Protein in Column 1 (SEQ ID NO:) | Column 4 Amino acid Sequence of DNA Binding Domain of the Effector Fusion Protein in Column 1 (SEQ ID NO:) |
|---|---|---|---|
| dCas9-VPR | 95 | 96 | 97 |
| dCas9-P300 | 98 | 99 | 97 |
| dCas9-VPR3 | 172 | 173 | 97 |

Example 4. Modulation of HNF4α Expression by ZF-Fusion Proteins

In order to test a single mRNA encoding a site-specific HNF4α disrupting agent, comprising a site-specific HNF4α targeting moiety which targets an HNF4α expression control region, e.g., a zing finger (ZF), and an effector comprising, e.g., VPR, (ZF-VPR fusion proteins), rather than dCas9-effector fusions with pooled sgRNAs, Zinc Finger DNA Binding Domain (DBD)-VPR (ZF-VPR) fusion proteins were designed as described above. Such fusion proteins which bind sites similar to or identical to the P1 targeting guide RNAs described in Examples 1 and 2 were evaluated for their ability to effect expression of HNF4α in vitro.

Several mRNAs encoding fusion proteins comprising a ZF DBD and a VPR domain were constructed (see Table 6A). Individual and pooled fusion protein encoding mRNAs were delivered to LX-2 cells as MC3 LNP formulations as described above. Expression of HNF4α was measured by qPCR as described above. Untreated HepG2 and dCas9-VPR-Pool 1 were included as positive controls.

Figure 11:
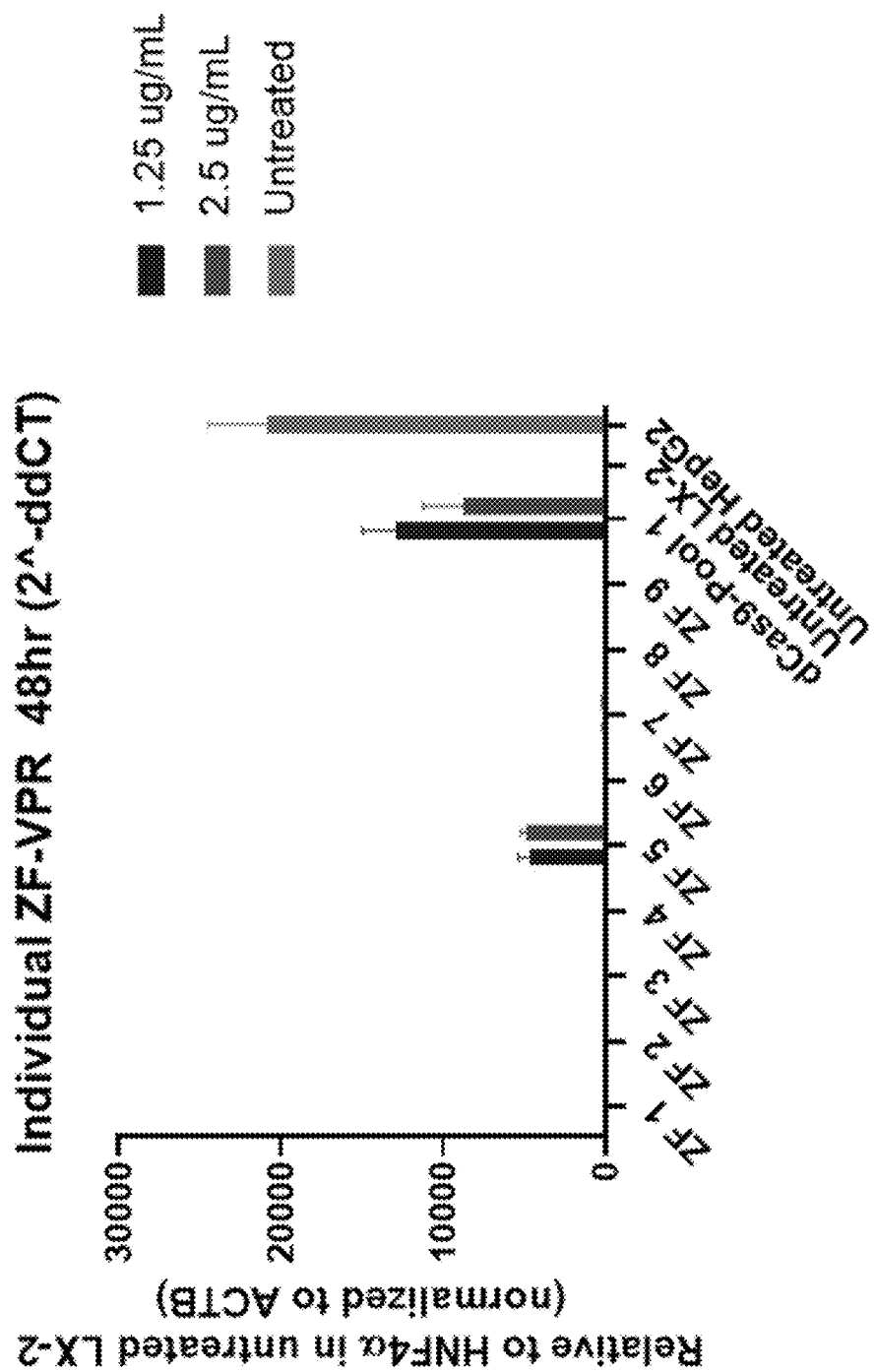
FIG. 11 is a graph depicting activation of HNF4α in LX-2 cells using ZF-VPR mRNAs.

As shown in FIG. 11, it was found that ZF005-VPR (also referred to as ZF5-VPR) showed robust upregulation of HNF4α. ZF007-VPR (also referred to as ZF7-VPR) also showed a quantifiable upregulation.

Example 5. Modulcation of HNF4α Expression by TALE-Fusion Proteins

In a further effort to use a single mRNA coding a site-specific HNF4α disrupting agent, comprising a site-specific HNF4α targeting moiety which targets an HNF4α expression control region, e.g., a Talen based DNA Binding Domain (DBD), and an effector comprising, e.g., VPR, (TAL-VPR fusion proteins), were designed. Such fusion proteins which bind sites similar to or identical to the P1 targeting guide RNAs described in Examples 1 and 2 were evaluated for their ability to effect expression of HNF4α in vitro.

Several mRNAs encoding fusion proteins of a TALEN DBD with a VPR domain were constructed (see Table 6A). Individual and pooled fusion protein encoding mRNAs were delivered to LX-2 cells as MC3 LNP formulations as described above. Expression of HNF4α was measured by qPCR as described above. Untreated HepG2 and dCas9-VPR-Pool 1 were included a positive controls. ZF5-VPR and ZF7-VPR were also included in the study as comparators.

Table 7 below shows the experiment design for the pooled TAL-VPR experiments.

TABLE 7

| TAL1-VPR | Pool X | Pools are made by mixing 1:1:1 of each TAL fusion protein. |
|---|---|---|
| TAL2-VPR | | |
| TAL3-VPR | | |
| TAL4-VPR | Pool Y | |
| TAL5-VPR | | |
| TAL6-VPR | | |
| TAL7-VPR | Pool Z | |
| TAL8-VPR | | |
| Unrelated domain-VPR | | |

Figure 12:
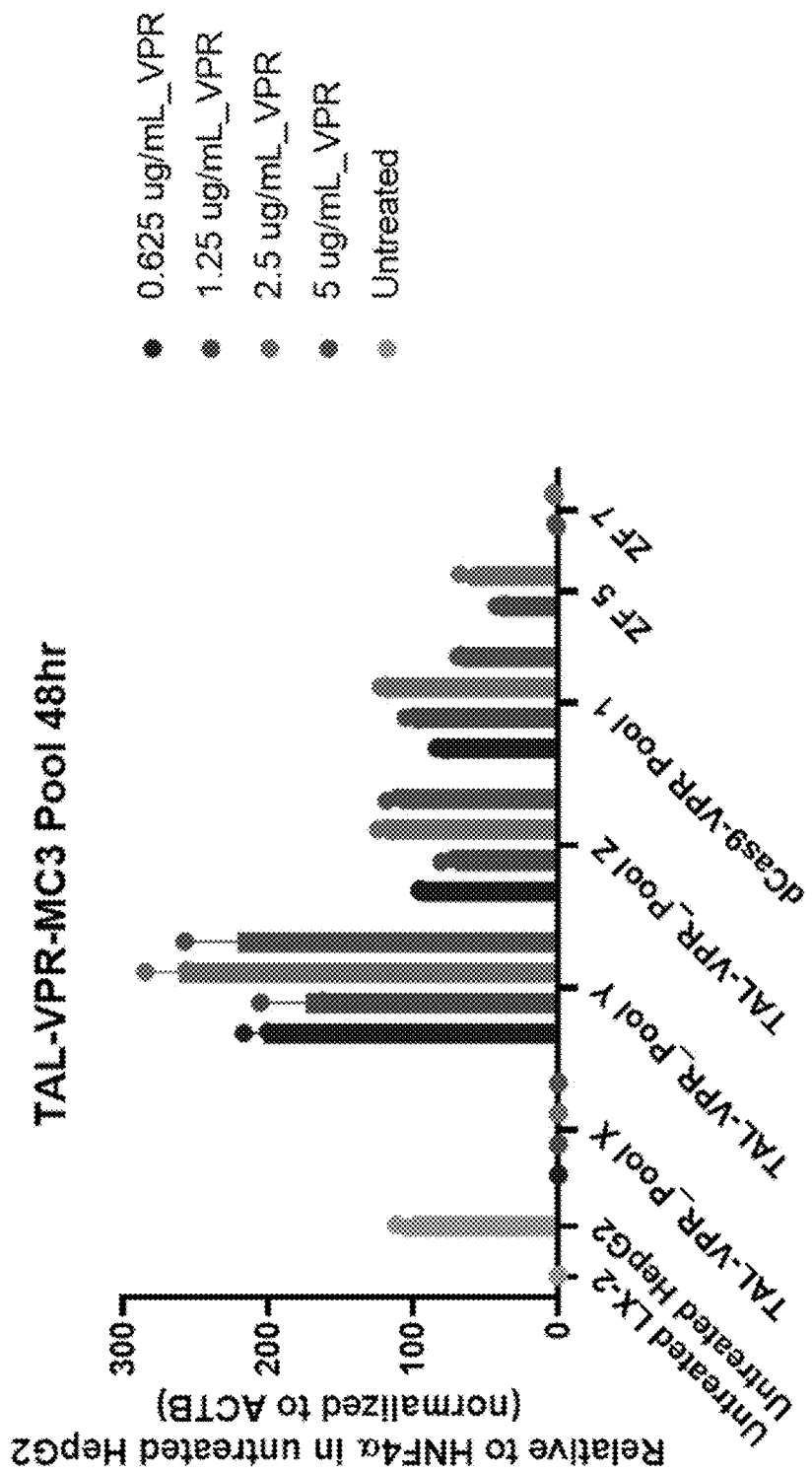
FIG. 12 is a graph depicting activation of HNF4α in LX-2 cells with TAL-VPRs and ZF-VPRs.

As shown in FIG. 12, it was found that pooled TALE based-VPR fusion proteins showed strong up-regulation of HNF4α expression Individually, each TAL-VPR fusion protein did not have significant activity to up-regulate the expression of HNF4α (data not shown). This Figure also demonstrates that the results described above for ZF5-VPR and Z7-VPR were reproducable.

Example 6. Modulation of HNF4α Expression with Codon Optimized ZF5-VPR and Synergy of the Combination of ZF5-VPR and ZF7-VPR in LX-2 Cells In this example, activation of HNF4α in LX-2 cells with codon optimized ZF5-VPR fusion proteins was evaluated. The objective was to analyze whether codon optimization of ZF5-VPR would improve activity of the ZF5-VPR fusion proteins at the HNF4α promoter. Another objective was to analyze whether the combination of ZF5-VPR and ZF7-VPR fusion proteins was synergistic in activating HNF4α expression.

The sequence for ZF5-VPR fusion proteins were sent to ATUM for codon optimization, a process that uses al algorithm to re-design ideal codon frequency and context to optimize translational efficiency. ATUM returned 6 new variants which all encode the same protein, each with different RNA sequences. (see Table 6A).

mRNAs for all five ATUM codon optimized ZF5-VPR, unaltered ZF5-VPR and ZF7-VPR were transfected into LX-2 cells as MC3 LNPs. Expression of HNF4α was measured by qPCR 48 hours after transfection.

Figure 13:
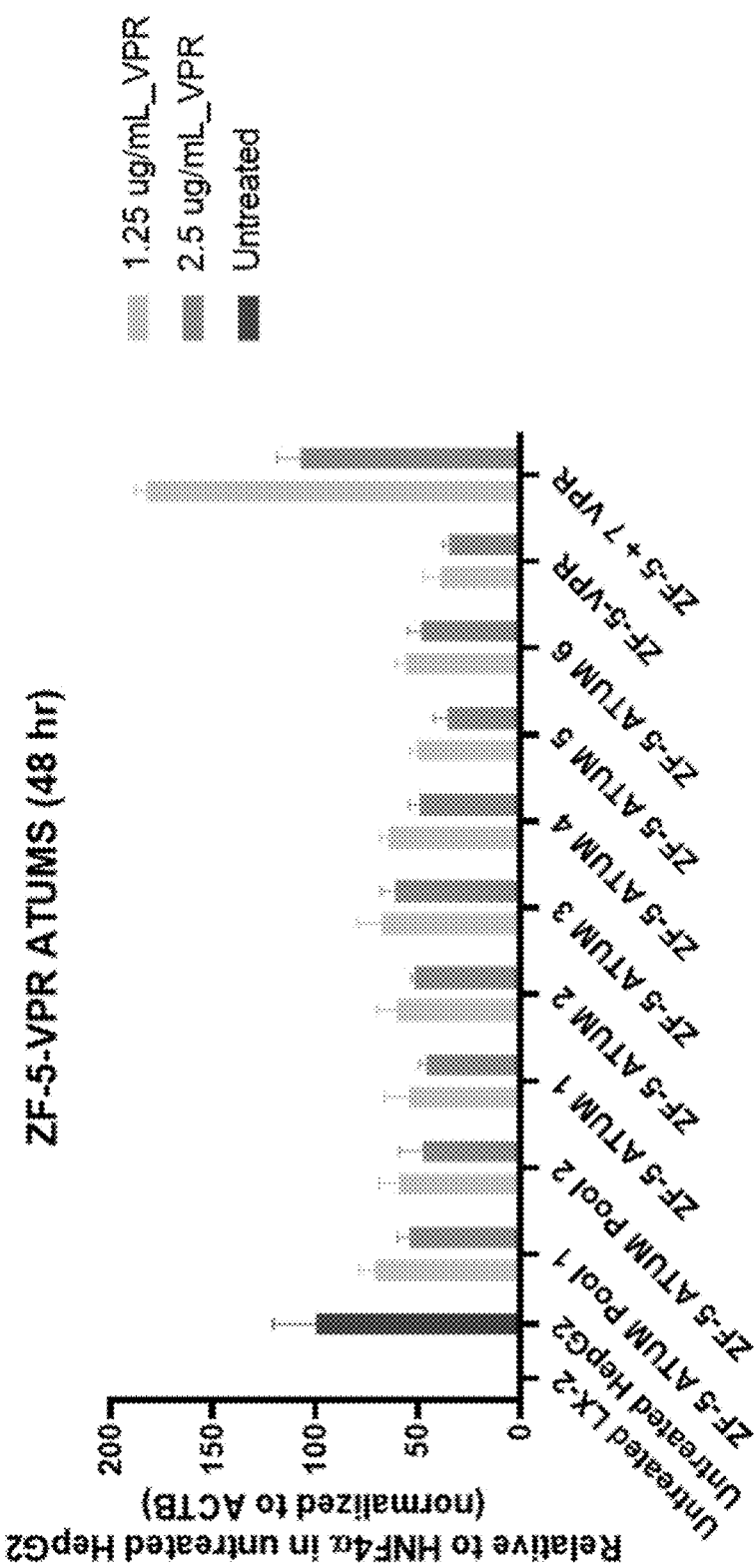
FIG. 13 is a graph depicting activation of HNF4α in LX-2 Cells with ATUM-Codon Optimized ZF5-VPR variants.

As shown in FIG. 13, ZF-5-VPR ATUM codon optimized variant 3 (ZF5.3-VPR) showed stronger upregulation of HNF4α expression as compared to the other codon-optimized variants. Co-transfecting ZF5-VPR and ZF7-VPR led to a supraphysiological (>200%) increase in expression of HNF4α, demonstrating synergy of the combination of these two fusion proteins. (In FIG. 13, Pool 1 is dCas9-VPR+GD-28431+GD-28432+GD-28433; Pool 2 is dCas9-VPR+GD-28434+GD-28435+GD-28436).

Example 7. Durability of Modulation of HNF4α Expression in K562 Cells

This example identified the effectors (VPR and/or P300) that was able to induce the longest lasting up-regulation of HNF4α expression. The example also measures how long the up-regulation of HNF4α in K562 could last when treated with various ZF-effector fusion proteins and various combinations of ZF-effector fusion proteins.

Various individual mRNAs encoding ZF-effector fusion proteins and combinations of the mRNAs were transfected into K562 cells and allowed to grow for 10 days in culture.

The following individual fusion proteins and combinations were tested in K562 cells, transfected with MC3 LNPs: ZF5-VPR, ZF5-P300, a combination of ZF5-VPR and ZF5-P300, or a combination of ZF5-VPR and ZF7-VPR (see Table 6A).

Transfections and quatifications were performed as described above. Briefly, untreated K562 cells were included as an assay control. K562 cells were treated with individual and different combination of effectors (2.5 μg/mL) in triplicate. Data points were collected over a period of 10 days. qPCR readout was used to measure mRNA expression. K562 cells were seeded at 100 k/well in triplicates: Time points were collected every 2 days for a total of 10 days. Three wells of untreated K562 were included as a control. RT qPCR for HNF4α was performed to measure the expression of HNF4α at each time point for similarly treated LX-2 cells.

Figure 14:
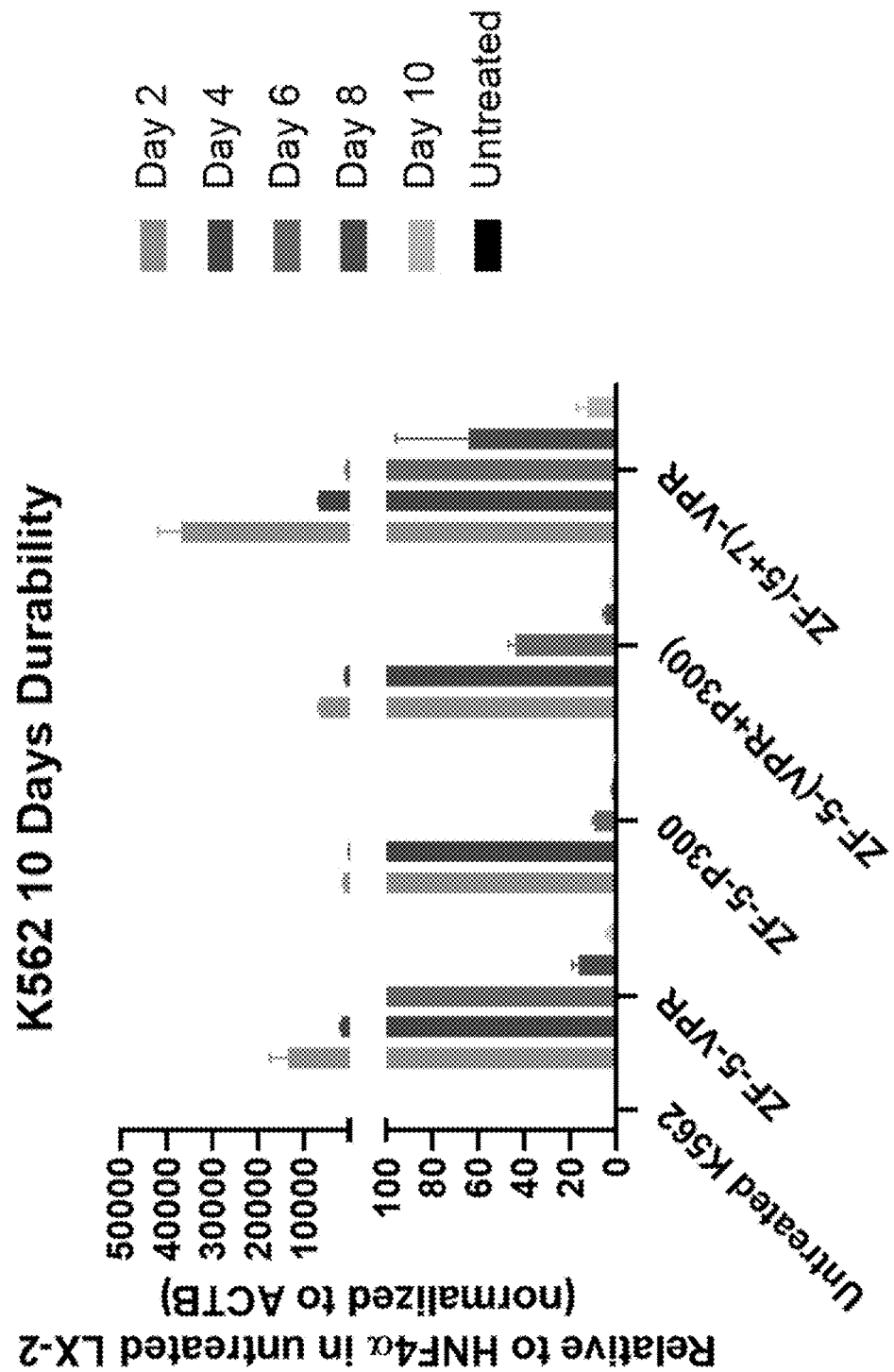
FIG. 14 is a graph depicting the durability of VPR activation of HNF4α in K562 cells with ZF5-VPR, ZF5-p300, ZF5-VPR and ZF5-p300, and ZF5-VPR and ZF7-VPR.
Figure 15:
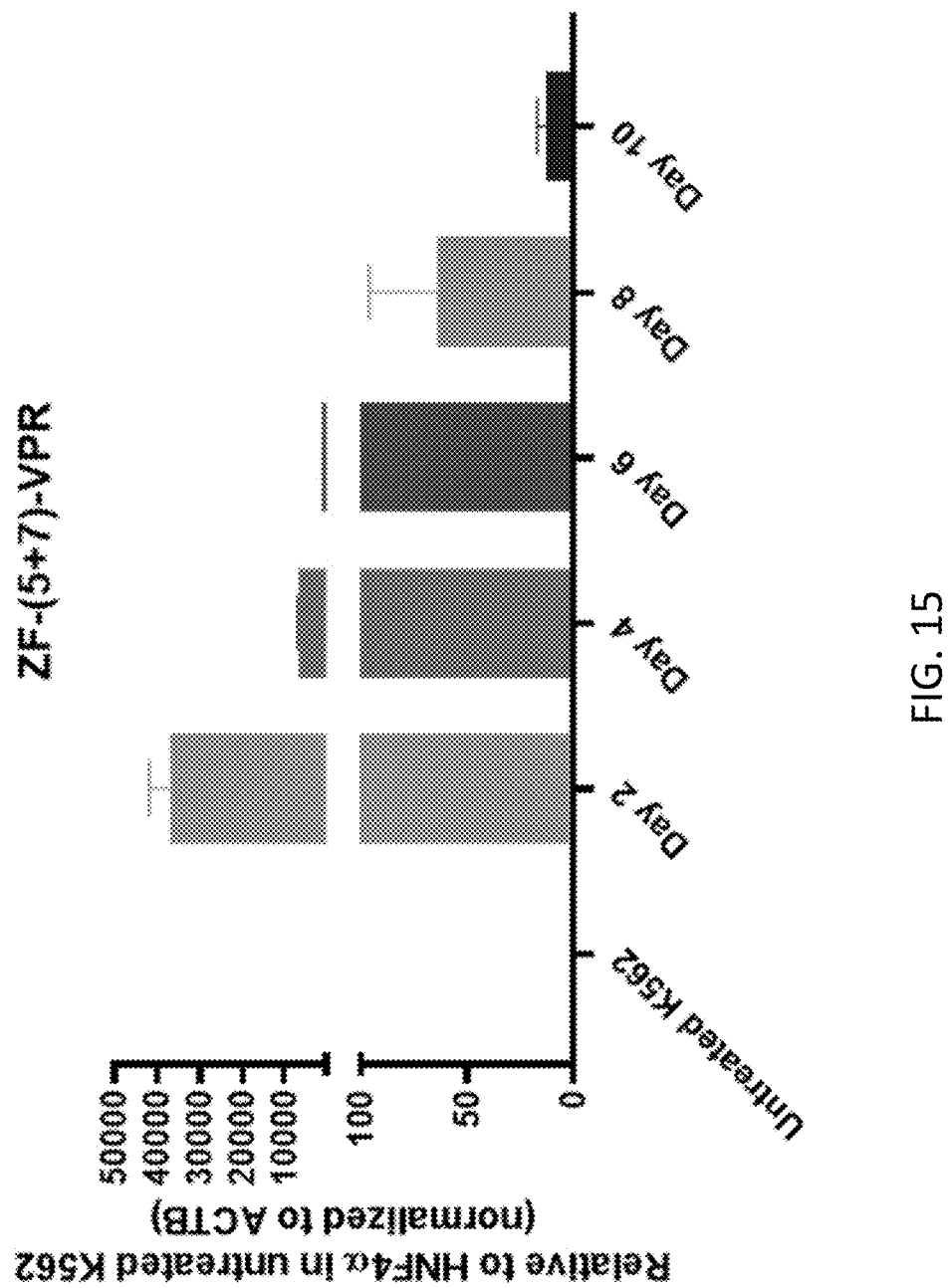
FIG. 15 is a graph depicting the durability of VPR activation of HNF4α in K562 cells with ZF5-VPR and ZF7-VPR.

As shown in FIGS. 14 and 15, HNF4α expression upregulation was observed in K562 cell until day 6 when any of the single fusion proteins or combinations of the fusion proteins were transfected. Co-transfection with mRNAs encoding ZF5-VPR and ZF7-VPR led to the highest and most durable increase of HNF4α expression in cultured cells, with detectable expression out to 10 days.

In another experiment, the durability of up-regulation of HNF4α expression in K562 when treated with ZF-5-VPR, ZF-5-P300, a combination of ZF5-VPR-ATUM 3 and ZF7-VPR (also referred to as ZF (5.3+7) or a combination of ZF5-PR and ZF7-VPR (also referred to as ZF-(5+7)-VPR) was determined.

K562 cells were treated with individual and different combination of effectors (2.5 ug/mL) in triplicate. Time points were collected over a period of 10 days. qPCR readout was used to measure mRNA expression. K562 cells were seeded at 100 k/well in triplicates: Time points were collected every 2 days for a total of 10 days. Three wells of untreated K562 were included as a control. RT qPCR was performed to measure the expression of HNF4α at each time point. Fusion protein were formulated in MC3 LNPs.

Figure 16:
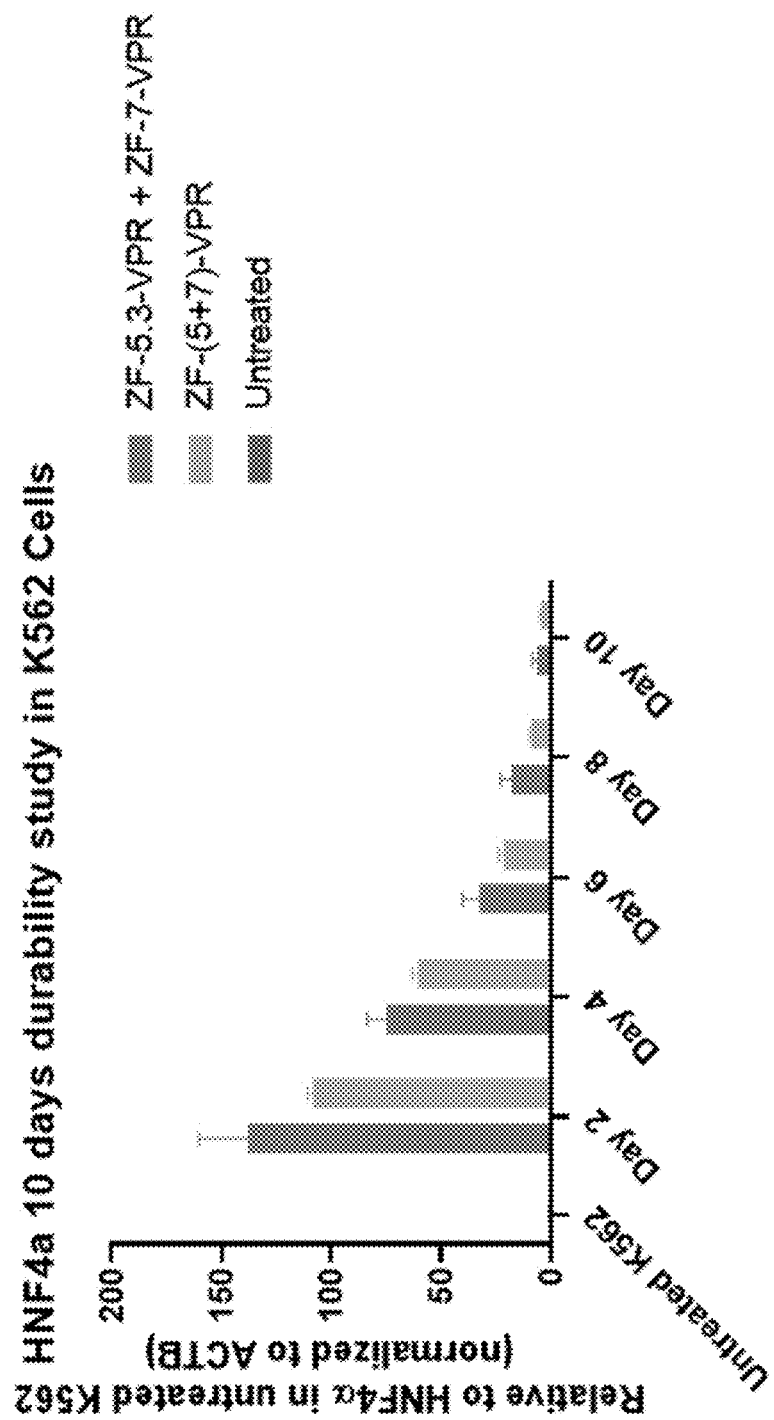
FIG. 16 is a graph depicting the durability of VPR activation of HNF4α in K562 cells with ZF5-VPR and ZF7-VPR, and ZF5.3-VPR and ZF7-VPR.

As shown in FIG. 16, HNF4α upregulation was observed in K562 cell until day 6 using both combinations of ZF5-VPR and ZF7-VPR and ZF5.3-VPR and ZF7-VPR. Both combinations of ZF5-VPR and ZF7-VPR and ZF5.3-VPR and ZF7-VPR showed slight upregulation at day 8 and 10.

Example 8. Modulation of Biomarker Genes Expression Following Activation of HNF4α in LX-2 Cells The first experiment of this example demonstrates the change in expression level of downstream biomarker genes following activation of HNF4α in LX-2 Cells. The objective of this experiment was to demonstrate that the HNF4α induced by dCas9-VPR in LX-2 cells is an active transcription factor by examining the effect of upregulating HNF4α expression on the expression of two downstream gene Cola1 and aSMA. Collagen 1a1 (Col1a1), and alpha-Smooth Muscle Actin (aSMA) are 2 proteins highly expressed in damaged liver cells and are key drivers of fibrosis in end-stage liver disease. Both of these genes are negatively-regulated by HNF4α.

LX-2 cells, which highly express Col1a1 and aSMA, were transfected with dCas-VPR-Pool 1 as described above, followed by qPCR measurement of HNF4A, Col1a1, and aSMA.

Figure 17:
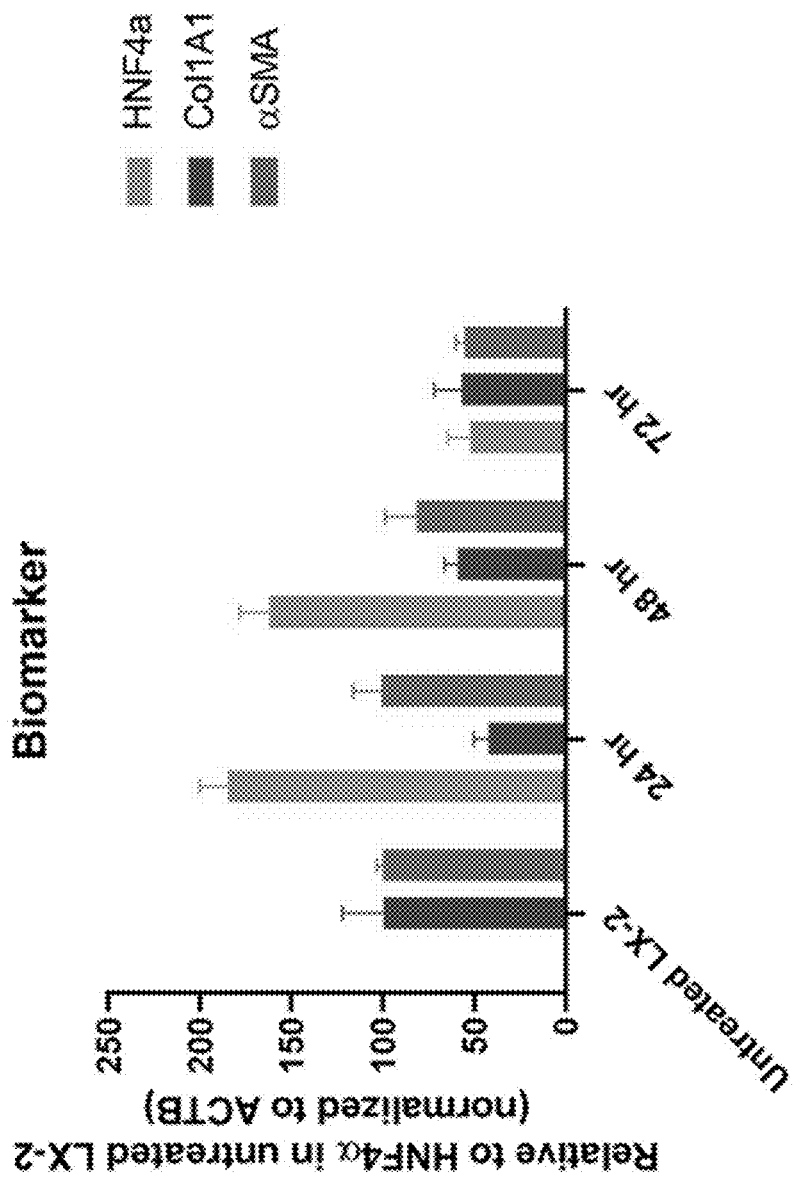
FIG. 17 is a graph depicting the change in expression level of biomarkers downstream of HNF4α following activation of HNF4α by dCas9-VPR in LX-2 cells.

As shown in FIG. 17, upregulation of HNF4α significantly down-regulateed expression of Col1a1 and aSMA.

The second experiment of this example demonstrates that the ZF-VPR fusion proteins also down-regulate expression of Col1a1 and aSMA, biomarkers of fibrotic liver disease.

Figure 18:
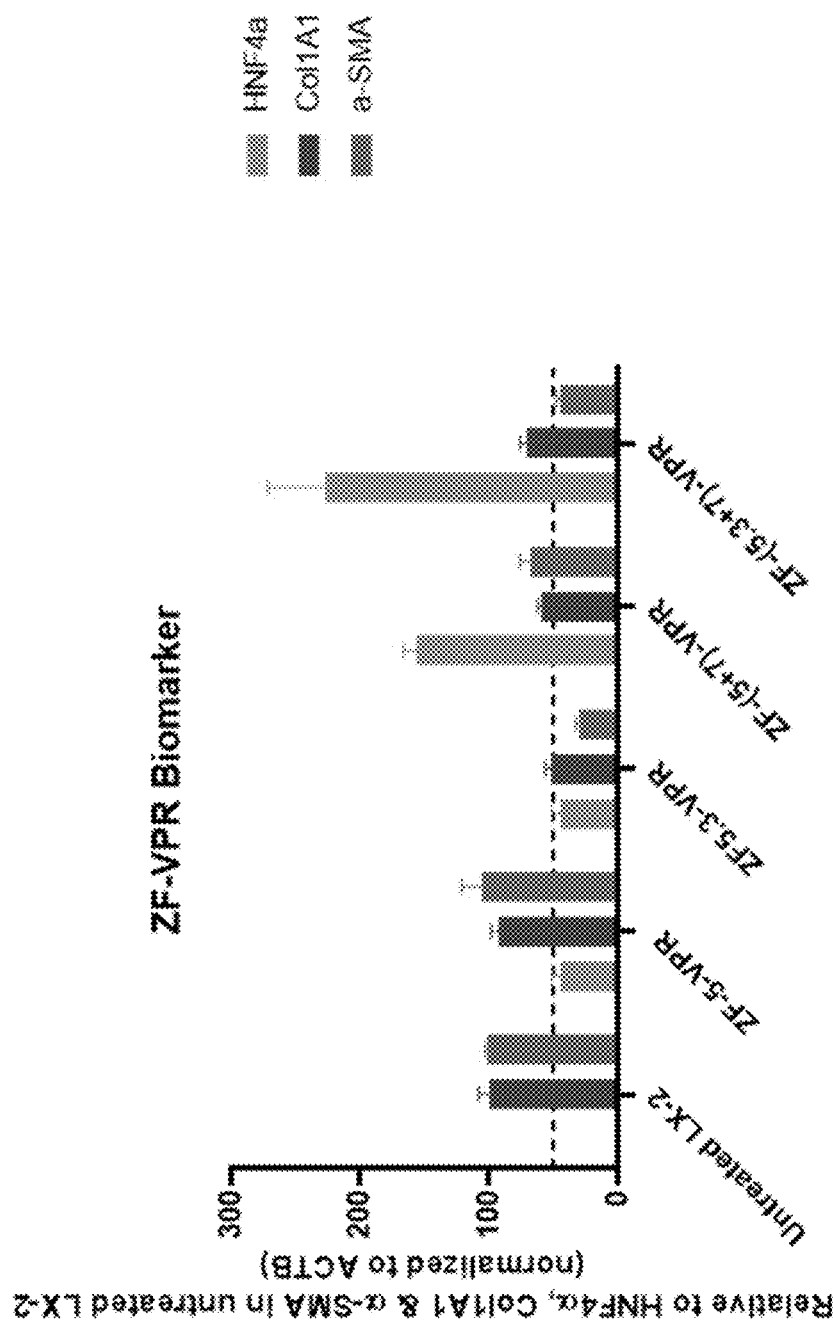
FIG. 18 is a graph depicting the change in expression level of biomarkers of HNF4α following activation of HNF4α by ZF5-VPR, ZF5.3-VPR, ZF5-VPR and ZF7-VPR, and ZF5.3-VPR and ZF7-VPR in LX-2 cells.

As shown in FIG. 18, biomarkers of fibrotic liver disease. Co1a1 and aSMA, were down-regulated in LX-2 cells following up-regulation of HNF4α with ZF5.3-VPR, a combination of ZF5-VPR and ZF7-VPR or a combination of ZF5.3-VPR and ZF7-VPR.

Example 9. Screening of Additional ZF-VPR Fusion Proteins and Combinations Thereof and Assessment of dCas9-VPR3

This example demonstrates that, in addition to the nine ZF-VPR proteins tested in Example 4, other ZF-VPR fusion proteins and various combinations thereof can upregulate the expression of HNF4α in LX-2 cells.

In the first experiment, fusion proteins were screened in LX-2 cells. Untreated Hep G2 cells were included as an assay control. LX-2 cells was treated with a single concentration of effector (2.5 μg/mL) in triplicate and incubated for 48 hours. ZF-5-VPR was used as a positive control for qPCR readout. LX-2 cells were transferctd as described above using MC3-LNP formulations. The mRNAs encoding the following ZF-VPR fusion proteins and various combinations were transferred: ZF5-VPR, ZF5-VPR-ATUM3 (ZF5.3-VPR), ZF-7-VPR, ZF-11-VPR, ZF-13-VPR, and ZF-15-VPR, or combinations thereof.

Figure 19:
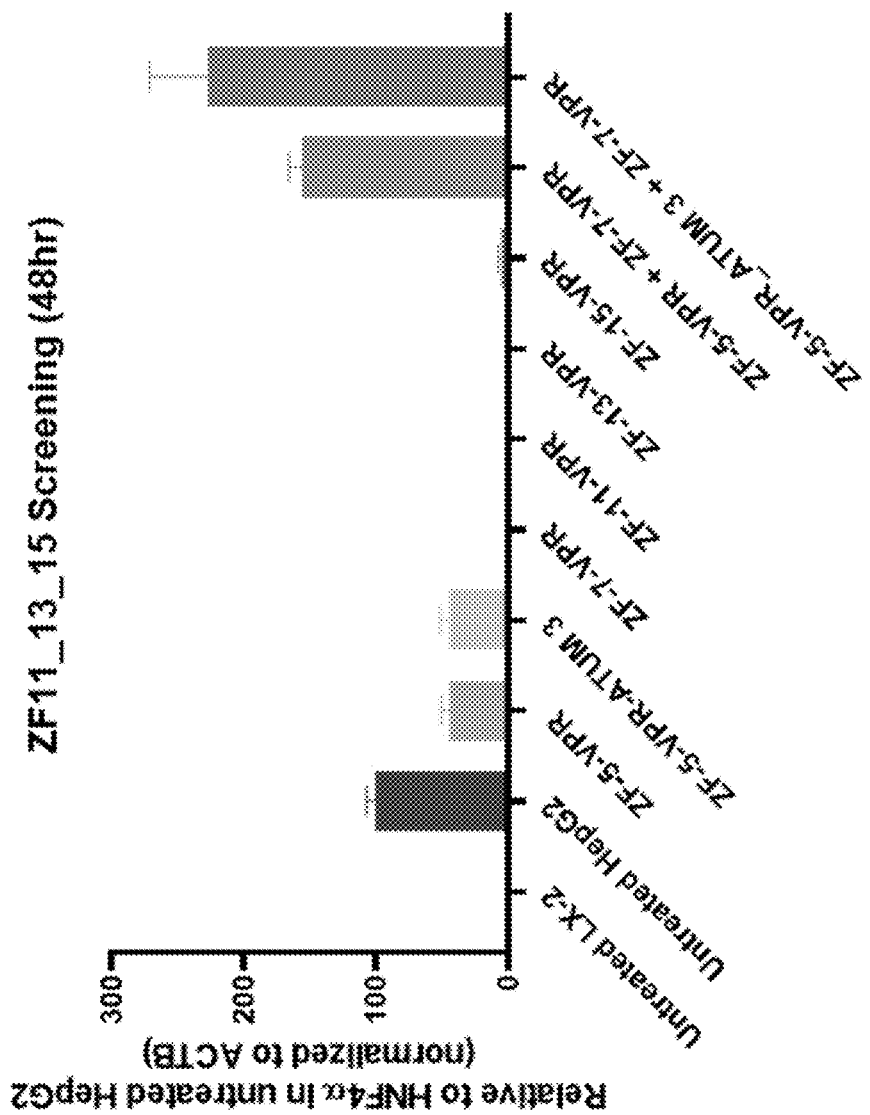
FIG. 19 is a graph depicting screening of ZF11, ZF13, and ZF14 in LX-2 cells and synergy in activating HNF4α by ZF5-VPR and ZF7-VPR, and ZF5.3-VPR and ZF7-VPR.

As shown in FIG. 19, stronger upregulation was observed when ZF5-VPR or ZF5.3-VPR were combined with ZF7-VPR. ZF7-VPR alone upregulated HNF4α in LX-2 cells to a low level.

In the second experiment, activation of HNF4α using dCas9-VPR3-Pool 1 or ZF-VPR fusion protein combinations was assessed. The objective was to evaluate the effects of various ZF-VPR fusion proteins in combinations in LX-2 Cells and test the new effector dCas9-VPR3 on LX-2 cells. VPR3 is a dCas9 DNA binding domain fused to 3 consecutive VPR domains in a row, expressed as a single protein. The combinations of ZF5.3-VPR and other ZF-VPRs that slightly upregulated the expression of HNF4α in LX-2 cells were tested for possible synergy. LX-2 cells were treated with a single concentration of effectors (2.5 ag/mL) in MC3 LNP formulations in triplicate for 48 hours. ZF-5-VPR was used as a positive control qPCR readout was used. The following combinations were tested: ZF5.3-VPR and ZF10-VPR, ZF5.3-VPR and ZF14-VPR, and ZF5.3-VPR and ZF15-VPR.

Figure 20:
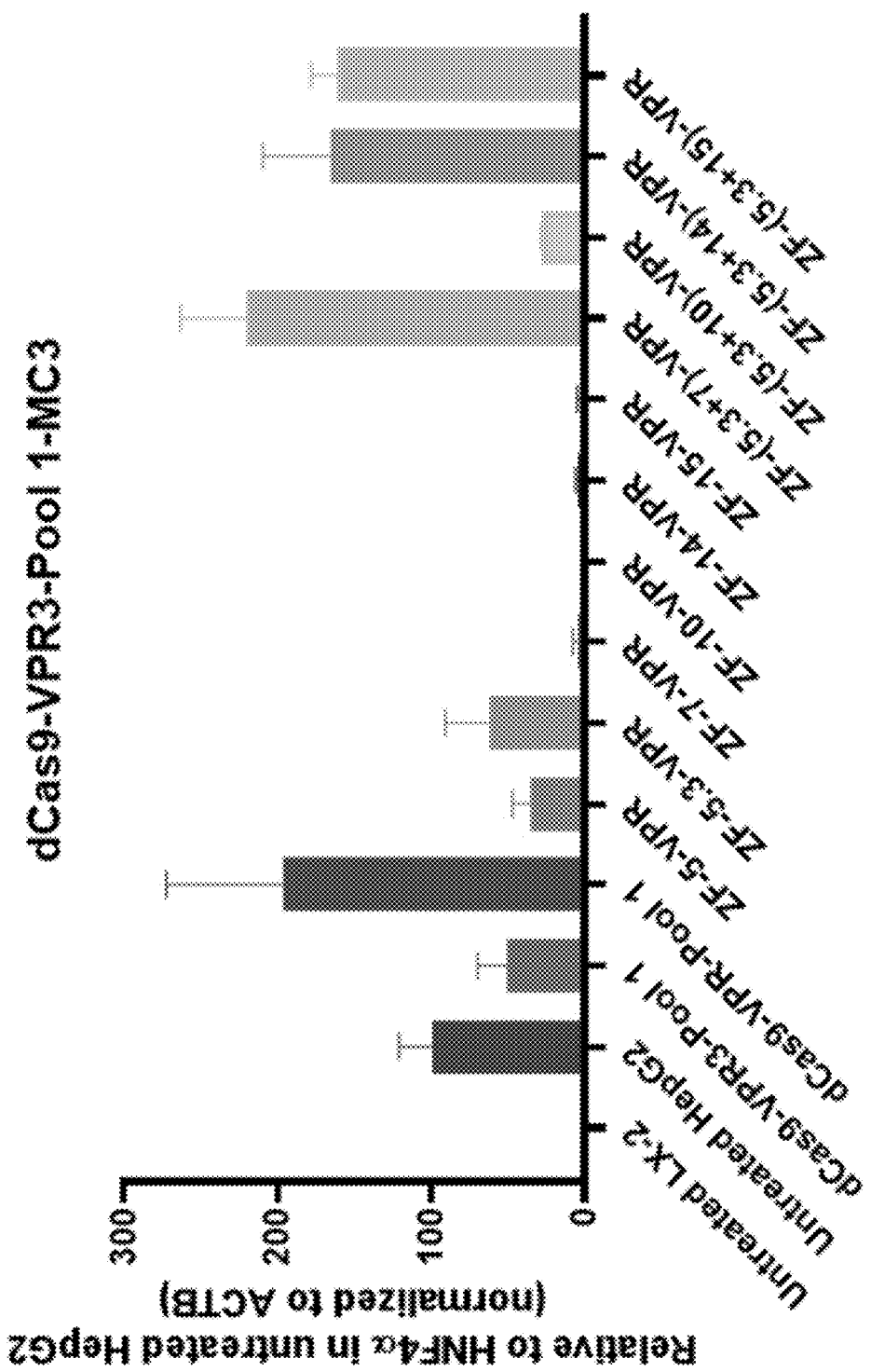
FIG. 20 is a graph depicting activation of HNF4α using dCas9-VPR3-Pool 1 and screening of ZF-VPR combinations

As shown in FIG. 20, dCas9-VPR3 Pool 1 upregulates HNF4α in LX-2 cells. ZF14-VPR and ZF15-VPR caused low upregulation of HNF4α when transfected individually. A strong synergistic upregulation (similar to the synergistic upregulation observed with ZF5.3-VPR+ZF7-VPR) was observed when ZF14-VPR or ZF15-VPR were in combination with ZF5.3-VPR.

Example 10. HNF4α Activation in FRG-KO Mouse Liver Humanized Hepatocytes (Yecuris Human Hepatocytes)

Yecuris human hepatocytes are primary human hepatocytes ex-planted into an immunocompromised mouse, allowed to proliferate, and then harvested for in vitro tissue culture. Yecuris hepatocytes were obtained as a cell suspension and plated in 96-well format at 40K cells/well. Cells were treated with ZF fusion protein-MC3 LNPs for 24 hrs at two concentrations, 2.5 μg/ml and 1.25 μg/ml. HNF4α gene expression was measured at 48 hrs post treatment. ZF7.4-VPR was used instead of ZF7-VPR.

Yecuris cells were transfected with mRNAs encoding ZF5-VPR, ZF5.3-VPR, ZF7.4-VPR, ZF5.3-VPR3 (a ZF5.3 protein fused to 3 consecutive VPR domains in a row, expressed as a single protein), ZF7.4-VPR3, and ZF5-alone (with no VPR fused to ZF5).

Figure 21:
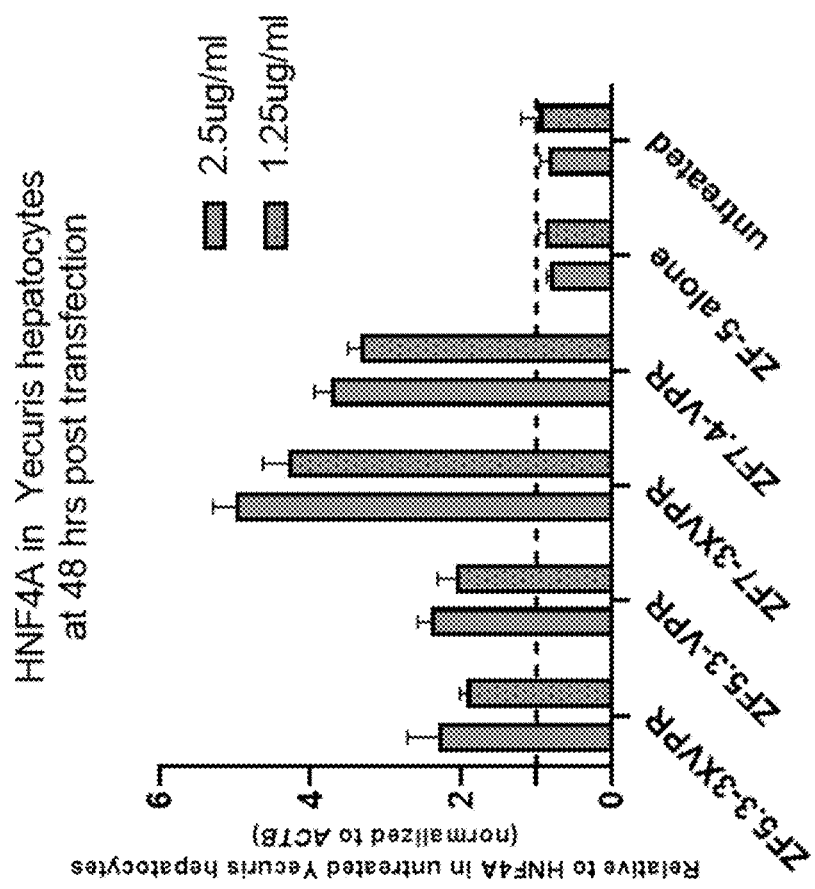
FIG. 21 is a graph depicting HNF4α activation in FRG-KO mouse liver humanized hepatocytes (Yecuris human hepatocytes).

As shown in FIG. 21, ZF5.3-VPR3 does not increase HNF4α gene expression compared to ZF5.3-VPR. An increase in HNF4α gene expression was observed with ZF7-VPR3 as compared to ZF7.4-VPR. As compared to the LX-2 cells, the ZF7-VPR constructs upregulate HNF4α to a greater level.

Example 11. Activation of LX-2 Cells with Bicistronic ZF5.3-VPR and and ZF7-VPR

This example evaluates whether ZF5.3-VPR (ZF5-VPR ATUM variant 3) and ZF7-VPR bicistronic constructs upregulate HNF4α in LX-2 cells to the same level as ZF5.3-VPR and ZF7-VPR when individually combined.

Untreated Hep G2 cells were included as an assay control. LX-2 cells were treated with a single concentration of the mRNAs encoding the fusion proteins (2.5 μg/mL) in triplicate. The combination of ZF5.3-VPR and ZF7-VPR was used as a positive control. qPCR readout was used to measure mRNA expression.

The following bicistronic mRNA constructs were tested: ZF5.3-VPR-tPT2A-ZF7-VPR, ZF7-VPR-tPT2A-ZF5.3-VPR, ZF5.3-VPR-tPT2A-ZF7-p300, and ZF7-p300-tPT2A-ZF5.3-VPR (see Table 6A). tPT2A is a linker that covalently links a first fusion protein to a second fusion protein to generate a bicistronic fusion protein.

Figure 22:
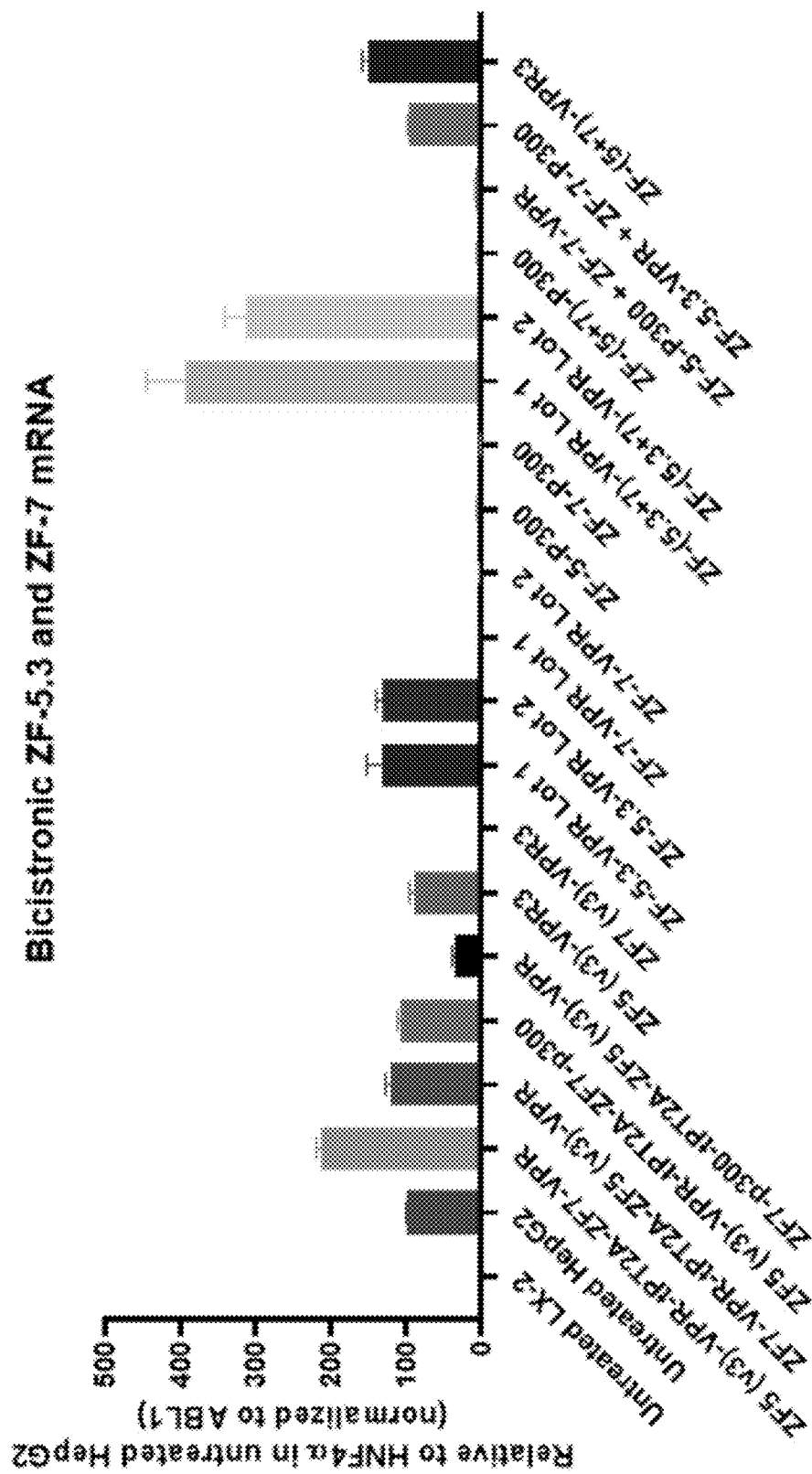
FIG. 22 is a graph depicting activation of HNF4α in LX-2 cells with bicistronic ZF5.3-VPR and ZF7-VPR.

As shown in FIG. 22, the bicistronic mRNA ZF5.3-VPR-tPT2A-ZF7-VPR induced stronger upregulation of HNF4α in LX-2 cells than the other 3 bicistronic mRNAs tested.

Example 12. Effect of Repeat Dosing of Yecuris Hepatocytes with VPR and p300 on HNF4α Gene Expression This example describes the effect of delivering multiple doses of mRNA encoding ZF-effector fusion proteins to cells. The objective was to evaluate whether additive or synergistic upregulation of HNF4α can be achieved by multiple dosing.

Yecuris hepatocytes were plated at 64K cells/well. Cells were treated with the combination of ZF5.3-VPR and ZF7-VPR or ZF7-p300 via MC3 LNP formulations at a final concentration of 1.25 μg/ml. Bicistronic mRNAs ZF5.3-VPR-tPT2A-ZF7-VPR, ZF7-VPR-tPT2A-ZF5.3-VPR, ZF5.3-VPR-tPT2A-ZF7-p300, ZF7-p300-tPT2A-ZF5.3-VPR in MC3 LNP formulations were used to treat cells at a final concentration of 1.25 μg/ml.

The expression level of the HNF4α was measured at 48 hrs post last dose. The dosing and harvesting schedule followed in this experiment is provided in Table 8, below.

TABLE 8

|  | Dose | Harvest |
|---|---|---|
| Day 0 | Dose 1 | |
| Day 1 | Media change | |
| Day 2 | | Harvest |
| Day 3 | Dose 2 | |
| Day 4 | Media change | |
| Day 5 | | Harvest |
| Day 6 | Dose 3 | |
| Day 7 | Media change | |
| Day 8 | | Harvest |

Figure 23:
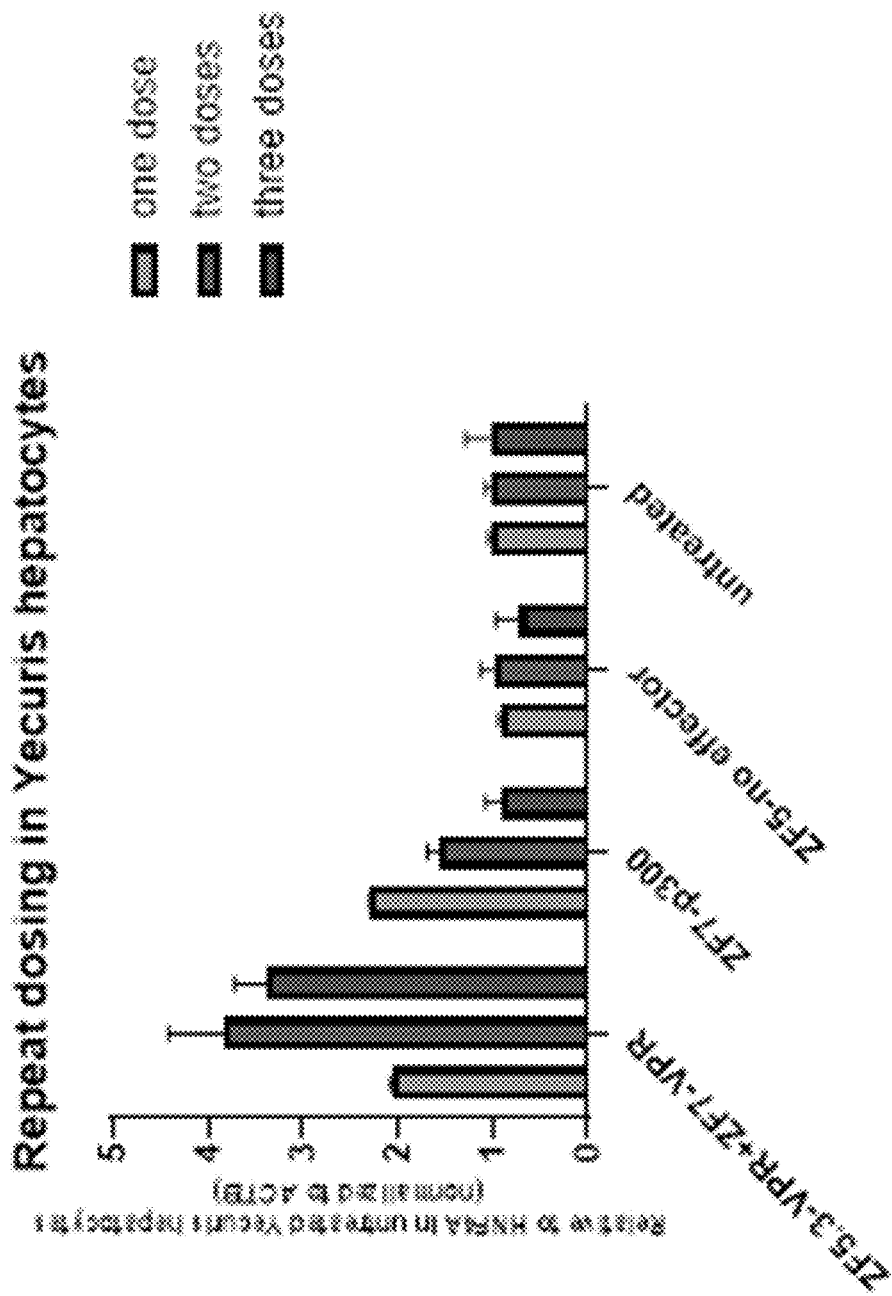
FIG. 23 is a graph depicting the effect of repeat dosing of Yecuris hepatocytes with various ZF-VPR and ZF-p300 on HNF4α gene expression.
Figure 24:
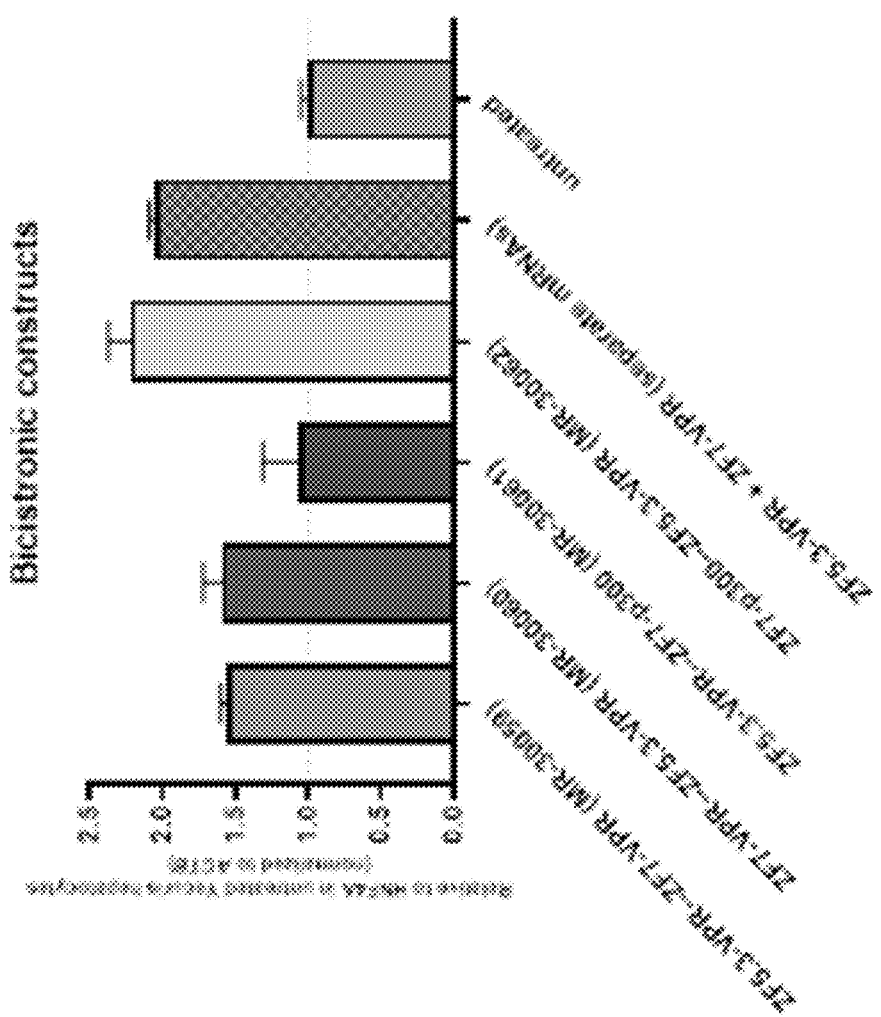
FIG. 24 is a graph depicting activation of HNF4α in Yecuris hepatocytes with bicistronic ZF-effector constructs.

As shown in FIG. 23, repeated dosing of cells with MC3 LNP formulations containing mRNAs encoding ZF-effector fusion proteins resulted in an additive increase of expression of HNF4α. The combination of ZF5.3-VPR and ZF7-VPR was stronger than ZF7-p300 in its activation potential. In addition, and as shown in FIG. 24, bicistronic constructs increased HNF4α in Yecuris hepatocytes, with ZF7-p300-tPT2A-ZF5.3-VPR providing the strongest upregulation.

Example 13: Activation of HNF4α in K562 Cells with Bi-cistronic mRNA-10 Day Durability Study This example describes the durability of the bicistronic constructs in K562 cells. K562 cells were treated with a single concentration of mRNAs encoding the fusion proteins in MC3 LNPs (2.5 μg/mL) in triplicate as described above.

The bicistronic mRNAs encoding the following constructs were tested: ZF5.3-VPR-tPT2A-ZF7-VPR, ZF7-VPR-tPT2A-ZF5.3-VPR, ZF5.3-VPR-tPT2A-ZF7-p300, ZF7-p300-tPT2A-ZF5.3-VPR.

Figure 25:
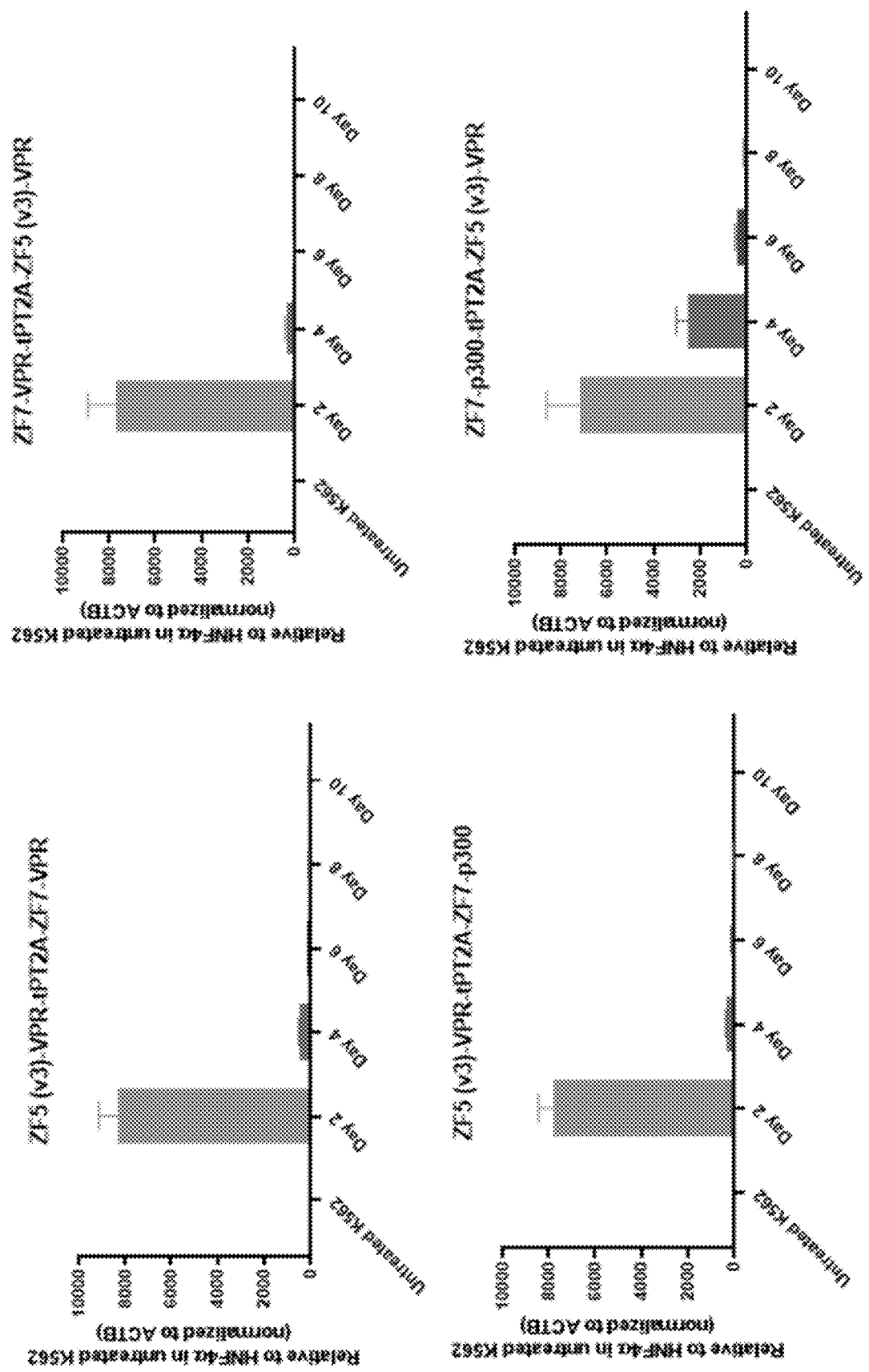
FIG. 25 is graph depicting the 10 days durability of VPR activation of HNF4α in K562 cells with bicistronic ZF-effector constructs.

As shown in FIG. 25, ZF7-p300-tPT2A-ZF5 (v3)-VPR showed better durability in K562 at later days as compared to other bicistronic constructs.

Table 9 below provides exemplary target nucleotide sequences and corresponding sgRNA nucleotide sequences suitable for use in the present invention.

TABLE 9

| Genomic Coordinates of the Target Start Site in Genome Reference Consortium Human Build 37 (GRCh37): Chromosome 20 | Strand | Target sequence | SEQ ID NO | PAM | sgRNA sequence [PlEASE ADVISE, NO "Us"] | SEQ ID NO |
|---|---|---|---|---|---|---|
| 43029193 | -1 | CCCTCACCCCCACCCCCTCC | 344 | CGG | CCCTCACCCCCACCCCCTCCGTTTTAGAGCTAGAAATAGCAAGTTAAAATAAGGCTAGTCCGTTATCAACTTGAAAAAGTGGCACCGAGTCGGTGCTTTT | 596 |
| 43029203 | 1 | TCCGGGAGGGGTGGGGGTG | 345 | AGG | TCCGGGAGGGGTGGGGGTGGTTTTAGAGCTAGAAATAGCAAGTTAAAATAAGGCTAGTCCGTTATCAACTTGAAAAAGTGGCACCGAGTCGGTGCTTTT | 597 |
| 43029204 | 1 | CCGGGAGGGGTGGGGGTGGA | 346 | GGG | CCGGGAGGGGTGGGGGTGAGTTTTAGAGCTAGAAATAGCAAGTTAAAATAAGGCTAGTCCGTTATCAACTTGAAAAAGTGGCACCGAGTCGGTGCTTTT | 598 |
| 43029211 | 1 | GGGGTGGGGGTGAGGGAAAC | 347 | AGG | GGGGTGGGGGTGAGGGAAACGTTTTAGAGCTAGAAATAGCAAGTTAAAATAAGGCTAGTCCGTTATCAACTTGAAAAAGTGGCACCGAGTCGGTGCTTTT | 599 |
| 43029223 | 1 | AGGGAAACAGGAGAATGTGA | 348 | TGG | AGGGAAACAGGAGAATGTGAGTTTTAGAGCTAGAAATAGCAAGTTAAAATAAGGCTAGTCCGTTATCAACTTGAAAAAGTGGCACCGAGTCGGTGCTTTT | 600 |
| 43029224 | 1 | GGGAAACAGGAGAATGTGAT | 349 | GGG | GGGAAACAGGAGAATGTGATGTTTTAGAGCTAGAAATAGCAAGTTAAAATAAGGCTAGTCCGTTATCAACTTGAAAAAGTGGCACCGAGTCGGTGCTTTT | 601 |
| 43029238 | 1 | TGTGATGGGAAAATCCGAGA | 350 | TGG | TGTGATGGGAAAATCCGAGAGTTTTAGAGCTAGAAATAGCAAGTTAAAATAAGGCTAGTCCGTTATCAACTTGAAAAAGTGGCACCGAGTCGGTGCTTTT | 602 |
| 43029241 | -1 | GGCCCAGGCTGGCTCCATCT | 351 | CGG | GGCCCAGGCTGGCTCCATCTGTTTTAGAGCTAGAAATAGCAAGTTAAAATAAGGCTAGTCCGTTATCAACTTGAAAAAGTGGCACCGAGTCGGTGCTTTT | 603 |
| 43029249 | 1 | AATCCGAGATGGAGCCAGCC | 352 | TGG | AATCCGAGATGGAGCCAGCCGTTTTAGAGCTAGAAATAGCAAGTTAAAATAAGGCTAGTCCGTTATCAACTTGAAAAAGTGGCACCGAGTCGGTGCTTTT | 604 |
| 43029250 | 1 | ATCCGAGATGGAGCCAGCCT | 353 | GGG | ATCCGAGATGGAGCCAGCCTGTTTTAGAGCTAGAAATAGCAAGTTAAAATAAGGCTAGTCCGTTATCAACTTGAAAAAGTGGCACCGAGTCGGTGCTTTT | 605 |
| 43029252 | -1 | CCAGTGTTTCTGGCCCAGGC | 354 | TGG | CCAGTGTTTCTGGCCCAGGCGTTTTAGAGCTAGAAATAGCAAGTTAAAATAAGGCTAGTCCGTTATCAACTTGAAAAAGTGGCACCGAGTCGGTGCTTTT | 606 |

TABLE 9-continued

| Genomic Coordinates of the Target Start Site in Genome Reference Consortium Human Build 37 (GRCh37): Chromosome 20 | Strand | Target sequence | SEQ ID NO | PAM | sgRNA sequence [PLEASE ADVISE, NO "Us"] | SEQ ID NO |
|---|---|---|---|---|---|---|
| 43029256 | -1 | GCTCCCAGTGTTTCTGGCCC | 355 | AGG | GCTCCCAGTGTTTCTGGCCCGTTTTAGAGCTAGAAATAGCAAGTTAAAATAAGGCTAGTCCGTTATCAACTTGAAAAAGTGGCACCGAGTCGGTGCTTTT | 607 |
| 43029262 | -1 | CCCACAGCTCCCAGTGTTTC | 356 | TGG | CCCACAGCTCCCAGTGTTTCGTTTTAGAGCTAGAAATAGCAAGTTAAAATAAGGCTAGTCCGTTATCAACTTGAAAAAGTGGCACCGAGTCGGTGCTTTT | 608 |
| 43029263 | 1 | CCAGCCTGGGCCAGAAACAC | 357 | TGG | CCAGCCTGGGCCAGAAACACGTTTTAGAGCTAGAAATAGCAAGTTAAAATAAGGCTAGTCCGTTATCAACTTGAAAAAGTGGCACCGAGTCGGTGCTTTT | 609 |
| 43029264 | 1 | CAGCCTGGGCCAGAAACACT | 358 | GGG | CAGCCTGGGCCAGAAACACTGTTTTAGAGCTAGAAATAGCAAGTTAAAATAAGGCTAGTCCGTTATCAACTTGAAAAAGTGGCACCGAGTCGGTGCTTTT | 610 |
| 43029272 | 1 | GCCAGAAACACTGGGAGCTG | 359 | TGG | GCCAGAAACACTGGGAGCTGTTTTAGAGCTAGAAATAGCAAGTTAAAATAAGGCTAGTCCGTTATCAACTTGAAAAAGTGGCACCGAGTCGGTGCTTTT | 611 |
| 43029273 | 1 | CCAGAAACACTGGGAGCTGT | 360 | GGG | CCAGAAACACTGGGAGCTGTGTTTTAGAGCTAGAAATAGCAAGTTAAAATAAGGCTAGTCCGTTATCAACTTGAAAAAGTGGCACCGAGTCGGTGCTTTT | 612 |
| 43029279 | 1 | ACACTGGGAGCTGTGGGAGA | 361 | CGG | ACACTGGGAGCTGTGGGAGAGTTTTAGAGCTAGAAATAGCAAGTTAAAATAAGGCTAGTCCGTTATCAACTTGAAAAAGTGGCACCGAGTCGGTGCTTTT | 613 |
| 43029284 | 1 | GGGAGCTGTGGGAGACGGAG | 362 | AGG | GGGAGCTGTGGGAGACGGAGGTTTTAGAGCTAGAAATAGCAAGTTAAAATAAGGCTAGTCCGTTATCAACTTGAAAAAGTGGCACCGAGTCGGTGCTTTT | 614 |
| 43029285 | 1 | GGAGCTGTGGGAGACGGAGA | 363 | GGG | GGAGCTGTGGGAGACGGAGAGTTTTAGAGCTAGAAATAGCAAGTTAAAATAAGGCTAGTCCGTTATCAACTTGAAAAAGTGGCACCGAGTCGGTGCTTTT | 615 |
| 43029286 | 1 | GAGCTGTGGGAGACGGAGAG | 364 | GGG | GAGCTGTGGGAGACGGAGAGGTTTTAGAGCTAGAAATAGCAAGTTAAAATAAGGCTAGTCCGTTATCAACTTGAAAAAGTGGCACCGAGTCGGTGCTTTT | 616 |
| 43029290 | 1 | TGTGGGAGACGGAGAGGGGC | 365 | AGG | TGTGGGAGACGGAGAGGGGCGTTTTAGAGCTAGAAATAGCAAGTTAAAATAAGGCTAGTCCGTTATCAACTTGAAAAAGTGGCACCGAGTCGGTGCTTTT | 617 |
| 43029291 | 1 | GTGGGAGACGGAGAGGGGCA | 366 | GGG | GTGGGAGACGGAGAGGGGCAGTTTTAGAGCTAGAAATAGCAAGTTAAAATAAGGCTAGTCCGTTATCAACTTGAAAAAGTGGCACCGAGTCGGTGCTTTT | 618 |

TABLE 9-continued

| Genomic Coordinates of the Target Start Site in Genome Reference Consortium Human Build 37 (GRCh37): Chromosome 20) | Strand | Target sequence | SEQ ID NO | PAM | sgRNA sequence [PLEASE ADVISE, NO "Us"] | SEQ ID NO |
|---|---|---|---|---|---|---|
| 43029294 | 1 | GGAGACGGAGAGGGGCAGGG | 367 | TGG | GGGAGACGGAGAGGGGCAGGGTTTTAGAGCTAGAAATAGCAAGTTAAAATAAGGCTAGTCCGTTATCAACTTGAAAAAGTGGCACCGAGTCGGTGCTTTT | 619 |
| 43029295 | 1 | GAGACGGAGAGGGGCAGGGT | 368 | GGG | GAGACGGAGAGGGGCAGGGTGTTTTAGAGCTAGAAATAGCAAGTTAAAATAAGGCTAGTCCGTTATCAACTTGAAAAAGTGGCACCGAGTCGGTGCTTTT | 620 |
| 43029303 | 1 | GAGGGGCAGGGTGGGATCAC | 369 | AGG | GAGGGGCAGGGTGGGATCACGTTTTAGAGCTAGAAATAGCAAGTTAAAATAAGGCTAGTCCGTTATCAACTTGAAAAAGTGGCACCGAGTCGGTGCTTTT | 621 |
| 43029304 | 1 | AGGGGCAGGGTGGGATCACA | 370 | GGG | AGGGGCAGGGTGGGATCACAGTTTTAGAGCTAGAAATAGCAAGTTAAAATAAGGCTAGTCCGTTATCAACTTGAAAAAGTGGCACCGAGTCGGTGCTTTT | 622 |
| 43029310 | 1 | AGGGTGGGATCACAGGGAGC | 371 | AGG | AGGGTGGGATCACAGGGAGCGTTTTAGAGCTAGAAATAGCAAGTTAAAATAAGGCTAGTCCGTTATCAACTTGAAAAAGTGGCACCGAGTCGGTGCTTTT | 623 |
| 43029315 | 1 | GGGATCACAGGGAGCAGGAG | 372 | CGG | GGGATCACAGGGAGCAGGAGGTTTTAGAGCTAGAAATAGCAAGTTAAAATAAGGCTAGTCCGTTATCAACTTGAAAAAGTGGCACCGAGTCGGTGCTTTT | 624 |
| 43029316 | 1 | GGATCACAGGGAGCAGGAGC | 373 | GGG | GGATCACAGGGAGCAGGAGCGTTTTAGAGCTAGAAATAGCAAGTTAAAATAAGGCTAGTCCGTTATCAACTTGAAAAAGTGGCACCGAGTCGGTGCTTTT | 625 |
| 43029317 | 1 | GATCACAGGGAGCAGGAGCG | 374 | GGG | GATCACAGGGAGCAGGAGCGGTTTTAGAGCTAGAAATAGCAAGTTAAAATAAGGCTAGTCCGTTATCAACTTGAAAAAGTGGCACCGAGTCGGTGCTTTT | 626 |
| 43029323 | 1 | AGGGAGCAGGAGCGGGAAT | 375 | TGG | AGGGAGCAGGAGCGGGAATGTTTTAGAGCTAGAAATAGCAAGTTAAAATAAGGCTAGTCCGTTATCAACTTGAAAAAGTGGCACCGAGTCGGTGCTTTT | 627 |
| 43029326 | 1 | GAGCAGGAGCGGGAATTGG | 376 | AGG | GAGCAGGAGCGGGAATTGGTTTTTAGAGCTAGAAATAGCAAGTTAAAATAAGGCTAGTCCGTTATCAACTTGAAAAAGTGGCACCGAGTCGGTGCTTTT | 628 |
| 43029335 | 1 | CGGGGAATTGGAGTGAATC | 377 | TGG | CGGGGAATTGGAGTGAATCGTTTTAGAGCTAGAAATAGCAAGTTAAAATAAGGCTAGTCCGTTATCAACTTGAAAAAGTGGCACCGAGTCGGTGCTTTT | 629 |

TABLE 9-continued

| Genomic Coordinates of the Target Start Site in Genome Reference Consortium Human Build 37 (GRCh37): Chromosome 20 | Strand | Target sequence | SEQ ID NO | PAM | sgRNA sequence [PLEASE ADVISE, NO "Us"] | SEQ ID NO |
|---|---|---|---|---|---|---|
| 43029347 | -1 | AATGGACTGGAAGTTTGGGA | 378 | GGG | AATGGACTGGAAGTTTGGGAGTTTTAGAGCTAGAAATAGCAAGTTAAAATAAGGCTAGTCCGTTATCAACTTGAAAAAGTGGCACCGAGTCGGTGCTTTT | 630 |
| 43029348 | -1 | GAATGGACTGGAAGTTTGGG | 379 | AGG | GAATGGACTGGAAGTTGGGGTTTTAGAGCTAGAAATAGCAAGTTAAAATAAGGCTAGTCCGTTATCAACTTGAAAAAGTGGCACCGAGTCGGTGCTTTT | 631 |
| 43029351 | -1 | GCAGAATGGACTGGAAGTTT | 380 | GGG | GCAGAATGGACTGGAAGTTTGTTTTAGAGCTAGAAATAGCAAGTTAAAATAAGGCTAGTCCGTTATCAACTTGAAAAAGTGGCACCGAGTCGGTGCTTTT | 632 |
| 43029352 | -1 | AGCAGAATGGACTGGAAGTT | 381 | TGG | AGCAGAATGGACTGGAAGTTGTTTTAGAGCTAGAAATAGCAAGTTAAAATAAGGCTAGTCCGTTATCAACTTGAAAAAGTGGCACCGAGTCGGTGCTTTT | 633 |
| 43029360 | -1 | CCCCTGGGAGCAGAATGGAC | 382 | TGG | CCCCTGGGAGCAGAATGGACGTTTTAGAGCTAGAAATAGCAAGTTAAAATAAGGCTAGTCCGTTATCAACTTGAAAAAGTGGCACCGAGTCGGTGCTTTT | 634 |
| 43029365 | -1 | CGGTTCCCCTGGGAGCAGAA | 383 | TGG | CGGTTCCCCTGGGAGCAGAAGTTTTAGAGCTAGAAATAGCAAGTTAAAATAAGGCTAGTCCGTTATCAACTTGAAAAAGTGGCACCGAGTCGGTGCTTTT | 635 |
| 43029369 | 1 | TTCCAGTCCATTCTGCTCCC | 384 | AGG | TTCCAGTCCATTCTGCTCCCGTTTTAGAGCTAGAAATAGCAAGTTAAAATAAGGCTAGTCCGTTATCAACTTGAAAAAGTGGCACCGAGTCGGTGCTTTT | 636 |
| 43029370 | 1 | TCCAGTCCATTCTGCTCCCA | 385 | GGG | TCCAGTCCATTCTGCTCCCAGTTTTAGAGCTAGAAATAGCAAGTTAAAATAAGGCTAGTCCGTTATCAACTTGAAAAAGTGGCACCGAGTCGGTGCTTTT | 637 |
| 43029371 | 1 | CCAGTCCATTCTGCTCCCAG | 386 | GGG | CCAGTCCATTCTGCTCCCAGGTTTTAGAGCTAGAAATAGCAAGTTAAAATAAGGCTAGTCCGTTATCAACTTGAAAAAGTGGCACCGAGTCGGTGCTTTT | 638 |
| 43029375 | -1 | CGCAGTTTCCCGGTTCCCCT | 387 | GGG | CGCAGTTTCCCGGTTCCCCTGTTTTAGAGCTAGAAATAGCAAGTTAAAATAAGGCTAGTCCGTTATCAACTTGAAAAAGTGGCACCGAGTCGGTGCTTTT | 639 |
| 43029376 | -1 | CCGCAGTTTCCCGGTTCCCC | 388 | TGG | CCGCAGTTTCCCGGTTCCCCGTTTTAGAGCTAGAAATAGCAAGTTAAAATAAGGCTAGTCCGTTATCAACTTGAAAAAGTGGCACCGAGTCGGTGCTTTT | 640 |
| 43029377 | 1 | CATTCTGCTCCCAGGGGAAC | 389 | CGG | CATTCTGCTCCCAGGGGAACGTTTTAGAGCTAGAAATAGCAAGTTAAAATAAGGCTAGTCCGTTATCAACTTGAAAAAGTGGCACCGAGTCGGTGCTTTT | 641 |

TABLE 9-continued

| Genomic Coordinates of the Target Start Site in Genome Reference Consortium Human Build 37 (GRCh37): Chromosome 20 | Strand | Target sequence | SEQ ID NO | PAM | sgRNA sequence [PLEASE ADVISE, NO "Us"] | SEQ ID NO |
|---|---|---|---|---|---|---|
| 43029378 | 1 | ATTCTGCTCCCAGGGGAACC | 390 | GGG | ATTCTGCTCCCAGGGGAACCGTTTTAGAGCTAGAAATAGCAAGTTAAAATAAGGCTAGTCCGTTATCAACTTGAAAAAGTGGCACCGAGTCGGTGCTTTT | 642 |
| 43029385 | -1 | CCAGTTCCCCGCAGTTTCC | 391 | CGG | CCAGTTCCCCGCAGTTCCGTTTTAGAGCTAGAAATAGCAAGTTAAAATAAGGCTAGTCCGTTATCAACTTGAAAAAGTGGCACCGAGTCGGTGCTTTT | 643 |
| 43029387 | 1 | CCAGGGGAACCGGGAAACTG | 392 | CGG | CCAGGGGAACCGGGAAACTGGTTTTAGAGCTAGAAATAGCAAGTTAAAATAAGGCTAGTCCGTTATCAACTTGAAAAAGTGGCACCGAGTCGGTGCTTTT | 644 |
| 43029388 | 1 | CAGGGGAACCGGGAAACTGC | 393 | GGG | CAGGGGAACCGGGAAACTGCGTTTTAGAGCTAGAAATAGCAAGTTAAAATAAGGCTAGTCCGTTATCAACTTGAAAAAGTGGCACCGAGTCGGTGCTTTT | 645 |
| 43029389 | 1 | AGGGGAACCGGGAAACTGCG | 394 | GGG | AGGGGAACCGGGAAACTGCGGTTTTAGAGCTAGAAATAGCAAGTTAAAATAAGGCTAGTCCGTTATCAACTTGAAAAAGTGGCACCGAGTCGGTGCTTTT | 646 |
| 43029390 | 1 | GGGGAACCGGGAAACTGCGG | 395 | GGG | GGGGAACCGGGAAACTGCGGGTTTTAGAGCTAGAAATAGCAAGTTAAAATAAGGCTAGTCCGTTATCAACTTGAAAAAGTGGCACCGAGTCGGTGCTTTT | 647 |
| 43029396 | 1 | CCGGGAAACTGCGGGGGAAC | 396 | TGG | CCGGGAAACTGCGGGGGAACGTTTTAGAGCTAGAAATAGCAAGTTAAAATAAGGCTAGTCCGTTATCAACTTGAAAAAGTGGCACCGAGTCGGTGCTTTT | 648 |
| 43029400 | 1 | GAAACTGCGGGGGAACTGGA | 397 | AGG | GAAACTGCGGGGGAACTGGAGTTTTAGAGCTAGAAATAGCAAGTTAAAATAAGGCTAGTCCGTTATCAACTTGAAAAAGTGGCACCGAGTCGGTGCTTTT | 649 |
| 43029401 | 1 | AAACTGCGGGGAACTGGAA | 398 | GGG | AAACTGCGGGGGAACTGGAAGTTTTAGAGCTAGAAATAGCAAGTTAAAATAAGGCTAGTCCGTTATCAACTTGAAAAAGTGGCACCGAGTCGGTGCTTTT | 650 |
| 43029417 | 1 | GGAAGGGAGCTCCCAGAACA | 399 | AGG | GGAAGGGAGCTCCCAGAACAGTTTTAGAGCTAGAAATAGCAAGTTAAAATAAGGCTAGTCCGTTATCAACTTGAAAAAGTGGCACCGAGTCGGTGCTTTT | 651 |
| 43029417 | -1 | ATCTTCTGGATCCTTGTTCT | 400 | GGG | ATCTTCTGGATCCTTGTTCTGTTTTAGAGCTAGAAATAGCAAGTTAAAATAAGGCTAGTCCGTTATCAACTTGAAAAAGTGGCACCGAGTCGGTGCTTTT | 652 |

TABLE 9-continued

| Genomic Coordinates of the Target Start Site in Genome Reference Consortium Human Build 37 (GRCh37): Chromosome 20) | Strand | Target sequence | SEQ ID NO | PAM | sgRNA sequence [PLEASE ADVISE, NO "Us"] | SEQ ID NO |
|---|---|---|---|---|---|---|
| 43029418 | -1 | AATCTTCTGGATCCTTGTTC | 401 | TGG | AATCTTCTGGATCCTTGTTCGTTTTAGAGCTAGAAATAGCAAGTTAAAATAAGGCTAGTCCGTTATCAACTTGAAAAAGTGGCACCGAGTCGGTGCTTTT | 653 |
| 43029431 | 1 | AGAACAAGGATCCAGAAGAT | 402 | TGG | AGAACAAGGATCCAGAAGATGTTTTAGAGCTAGAAATAGCAAGTTAAAATAAGGCTAGTCCGTTATCAACTTGAAAAAGTGGCACCGAGTCGGTGCTTTT | 654 |
| 43029431 | -1 | GGCCCCAGATGCCAATCTTC | 403 | TGG | GGCCCCAGATGCCAATCTTCGTTTTAGAGCTAGAAATAGCAAGTTAAAATAAGGCTAGTCCGTTATCAACTTGAAAAAGTGGCACCGAGTCGGTGCTTTT | 655 |
| 43029438 | 1 | GGATCCAGAAGATTGGCATC | 404 | TGG | GGATCCAGAAGATTGGCATCGTTTTAGAGCTAGAAATAGCAAGTTAAAATAAGGCTAGTCCGTTATCAACTTGAAAAAGTGGCACCGAGTCGGTGCTTTT | 656 |
| 43029439 | 1 | GATCCAGAAGATTGGCATCT | 405 | GGG | GATCCAGAAGATTGGCATCTGTTTTAGAGCTAGAAATAGCAAGTTAAAATAAGGCTAGTCCGTTATCAACTTGAAAAAGTGGCACCGAGTCGGTGCTTTT | 657 |
| 43029440 | 1 | ATCCAGAAGATTGGCATCTG | 406 | GGG | ATCCAGAAGATTGGCATCTGGTTTTAGAGCTAGAAATAGCAAGTTAAAATAAGGCTAGTCCGTTATCAACTTGAAAAAGTGGCACCGAGTCGGTGCTTTT | 658 |
| 43029445 | 1 | GAAGATTGGCATCTGGGGCC | 407 | TGG | GAAGATTGGCATCTGGGGCCGTTTTAGAGCTAGAAATAGCAAGTTAAAATAAGGCTAGTCCGTTATCAACTTGAAAAAGTGGCACCGAGTCGGTGCTTTT | 659 |
| 43029446 | 1 | AAGATTGGCATCTGGGGCCT | 408 | GGG | AAGATTGGCATCTGGGGCCTGTTTTAGAGCTAGAAATAGCAAGTTAAAATAAGGCTAGTCCGTTATCAACTTGAAAAAGTGGCACCGAGTCGGTGCTTTT | 660 |
| 43029452 | -1 | GATTTAGAAACCTAAATCCC | 409 | AGG | GATTTAGAAACCTAAATCCCGTTTTAGAGCTAGAAATAGCAAGTTAAAATAAGGCTAGTCCGTTATCAACTTGAAAAAGTGGCACCGAGTCGGTGCTTTT | 661 |
| 43029453 | 1 | GCATCTGGGGCCTGGGATTT | 410 | AGG | GCATCTGGGGCCTGGGATTTGTTTTAGAGCTAGAAATAGCAAGTTAAAATAAGGCTAGTCCGTTATCAACTTGAAAAAGTGGCACCGAGTCGGTGCTTTT | 662 |
| 43029467 | 1 | GGATTTAGGTTTCTAAATCG | 411 | TGG | GGATTTAGGTTTCTAAATCGGTTTTAGAGCTAGAAATAGCAAGTTAAAATAAGGCTAGTCCGTTATCAACTTGAAAAAGTGGCACCGAGTCGGTGCTTTT | 663 |
| 43029468 | 1 | GATTTAGGTTTCTAAATCGT | 412 | GGG | GATTTAGGTTTCTAAATCGTGTTTTAGAGCTAGAAATAGCAAGTTAAAATAAGGCTAGTCCGTTATCAACTTGAAAAAGTGGCACCGAGTCGGTGCTTTT | 664 |

TABLE 9-continued

| Genomic Coordinates of the Target Start Site in Genome Reference Consortium Human Build 37 (GRCh37): Chromosome 20 | Strand | Target sequence | SEQ ID NO | PAM | sgRNA sequence [PLEASE ADVISE, NO "Us"] | SEQ ID NO |
|---|---|---|---|---|---|---|
| 43029474 | 1 | GGTTTCTAAATCGTGGGCCA | 413 | TGG | GGTTTCTAAATCGTGGGCCAGTTTTAGAGCTAGAAATAGCAAGTTAAAATAAGGCTAGTCCGTTATCAACTTGAAAAAGTGGCACCGAGTCGGTGCTTTT | 665 |
| 43029475 | 1 | GTTTCTAAATCGTGGGCCAT | 414 | GGG | GTTTCTAAATCGTGGGCCATGTTTTAGAGCTAGAAATAGCAAGTTAAAATAAGGCTAGTCCGTTATCAACTTGAAAAAGTGGCACCGAGTCGGTGCTTTT | 666 |
| 43029476 | 1 | TTTCTAAATCGTGGGCCATG | 415 | GGG | TTTCTAAATCGTGGGCCATGGTTTTAGAGCTAGAAATAGCAAGTTAAAATAAGGCTAGTCCGTTATCAACTTGAAAAAGTGGCACCGAGTCGGTGCTTTT | 667 |
| 43029480 | -1 | GCAGAGATAAGGCTGCCCCA | 416 | TGG | GCAGAGATAAGGCTGCCCCAGTTTTAGAGCTAGAAATAGCAAGTTAAAATAAGGCTAGTCCGTTATCAACTTGAAAAAGTGGCACCGAGTCGGTGCTTTT | 668 |
| 43029491 | -1 | TCAATGCTTTTGCAGAGATA | 417 | AGG | TCAATGCTTTTGCAGAGATAGTTTTAGAGCTAGAAATAGCAAGTTAAAATAAGGCTAGTCCGTTATCAACTTGAAAAAGTGGCACCGAGTCGGTGCTTTT | 669 |
| 43029504 | 1 | TTATCTCTGCAAAAGCATTG | 418 | AGG | TTATCTCTGCAAAAGCATTGGTTTTAGAGCTAGAAATAGCAAGTTAAAATAAGGCTAGTCCGTTATCAACTTGAAAAAGTGGCACCGAGTCGGTGCTTTT | 670 |
| 43029505 | 1 | TATCTCTGCAAAAGCATTGA | 419 | GGG | TATCTCTGCAAAAGCATTGAGTTTTAGAGCTAGAAATAGCAAGTTAAAATAAGGCTAGTCCGTTATCAACTTGAAAAAGTGGCACCGAGTCGGTGCTTTT | 671 |
| 43029523 | 1 | GAGGGTAGAAGTCAATGATT | 420 | TGG | GAGGGTAGAAGTCAATGATTGTTTTAGAGCTAGAAATAGCAAGTTAAAATAAGGCTAGTCCGTTATCAACTTGAAAAAGTGGCACCGAGTCGGTGCTTTT | 672 |
| 43029524 | 1 | AGGGTAGAAGTCAATGATTT | 421 | GGG | AGGGTAGAAGTCAATGATTTGTTTTAGAGCTAGAAATAGCAAGTTAAAATAAGGCTAGTCCGTTATCAACTTGAAAAAGTGGCACCGAGTCGGTGCTTTT | 673 |
| 43029540 | 1 | ATTTGGGAAGTTATTGAATT | 422 | AGG | ATTTGGGAAGTTATTGAATTGTTTTAGAGCTAGAAATAGCAAGTTAAAATAAGGCTAGTCCGTTATCAACTTGAAAAAGTGGCACCGAGTCGGTGCTTTT | 674 |
| 43029541 | 1 | TTTGGGAAGTTATTGAATTA | 423 | GGG | TTTGGGAAGTTATTGAATTAGTTTTAGAGCTAGAAATAGCAAGTTAAAATAAGGCTAGTCCGTTATCAACTTGAAAAAGTGGCACCGAGTCGGTGCTTTT | 675 |

TABLE 9-continued

| Genomic Coordinates of the Target Start Site in Genome Reference Consortium Human Build 37 (GRCh37): Chromosome 20) | Strand | Target sequence | SEQ ID NO | PAM | sgRNA sequence [PLEASE ADVISE, NO "Us"] | SEQ ID NO |
|---|---|---|---|---|---|---|
| 43029542 | 1 | TTGGGAAGTTATTGAATTAG | 424 | GGG | TTGGGAAGTTATTGAATTAGGTTTTAGAGCTAGAAATAGCAAGTTAAAATAAGGCTAGTCCGTTATCAACTTGAAAAAGTGGCACCGAGTCGGTGCTTTT | 676 |
| 43029549 | 1 | GTTATTGAATTAGGGATCT | 425 | CGG | GTTATTGAATTAGGGATCTGTTTTAGAGCTAGAAATAGCAAGTTAAAATAAGGCTAGTCCGTTATCAACTTGAAAAAGTGGCACCGAGTCGGTGCTTTT | 677 |
| 43029552 | 1 | ATTGAATTAGGGGATCTCGG | 333 | AGG | ATTGAATTAGGGGATCTCGGTTTTAGAGCTAGAAATAGCAAGTTAAAATAAGGCTAGTCCGTTATCAACTTGAAAAAGTGGCACCGAGTCGGTGCTTTT | 678 |
| 43029556 | 1 | AATTAGGGGATCTCGGAGGT | 426 | AGG | AATTAGGGGATCTCGGAGGTGTTTTAGAGCTAGAAATAGCAAGTTAAAATAAGGCTAGTCCGTTATCAACTTGAAAAAGTGGCACCGAGTCGGTGCTTTT | 679 |
| 43029577 | -1 | GCATTCTAACTGATACTATC | 427 | AGG | GCATTCTAACTGATACTATCGTTTTAGAGCTAGAAATAGCAAGTTAAAATAAGGCTAGTCCGTTATCAACTTGAAAAAGTGGCACCGAGTCGGTGCTTTT | 680 |
| 43029597 | 1 | ATCAGTTAGAATGCCTGACT | 428 | TGG | ATCAGTTAGAATGCCTGACTGTTTTAGAGCTAGAAATAGCAAGTTAAAATAAGGCTAGTCCGTTATCAACTTGAAAAAGTGGCACCGAGTCGGTGCTTTT | 681 |
| 43029598 | 1 | TCAGTTAGAATGCCTGACTT | 429 | GGG | TCAGTTAGAATGCCTGACTTGTTTTAGAGCTAGAAATAGCAAGTTAAAATAAGGCTAGTCCGTTATCAACTTGAAAAAGTGGCACCGAGTCGGTGCTTTT | 682 |
| 43029599 | 1 | CAGTTAGAATGCCTGACTTG | 430 | GGG | CAGTTAGAATGCCTGACTTGGTTTTAGAGCTAGAAATAGCAAGTTAAAATAAGGCTAGTCCGTTATCAACTTGAAAAAGTGGCACCGAGTCGGTGCTTTT | 683 |
| 43029599 | -1 | AGCCATTGTCACCCCAAGTC | 340 | AGG | AGCCATTGTCACCCCAAGTCGTTTTAGAGCTAGAAATAGCAAGTTAAAATAAGGCTAGTCCGTTATCAACTTGAAAAAGTGGCACCGAGTCGGTGCTTTT | 684 |
| 43029608 | 1 | TGCCTGACTTGGGGTGACAA | 431 | TGG | TGCCTGACTTGGGGTGACAAGTTTTAGAGCTAGAAATAGCAAGTTAAAATAAGGCTAGTCCGTTATCAACTTGAAAAAGTGGCACCGAGTCGGTGCTTTT | 685 |
| 43029613 | 1 | GACTTGGGGTGACAATGGCT | 334 | TGG | GACTTGGGGTGACAATGGCTGTTTTAGAGCTAGAAATAGCAAGTTAAAATAAGGCTAGTCCGTTATCAACTTGAAAAAGTGGCACCGAGTCGGTGCTTTT | 686 |
| 43029616 | 1 | TTGGGGTGACAATGGCTTGG | 432 | AGG | TTGGGGTGACAATGCCTTGGTTTAGAGCTAGAAATAGCAAGTTAAAATAAGGCTAGTCCGTTATCAACTTGAAAAAGTGGCACCGAGTCGGTGCTTTT | 687 |

TABLE 9-continued

| Genomic Coordinates of the Target Start Site in Genome Reference Consortium Human Build 37 (GRCh37): Chromosome 20 | Strand | Target sequence | SEQ ID NO | PAM | sgRNA sequence [PLEASE ADVISE, NO "Us"] | SEQ ID NO |
|---|---|---|---|---|---|---|
| 43029617 | 1 | TGGGGTGACAATGGC TTGGA | 433 | GGG | TGGGGTGACAATGGCTTGGAGTTTTAGAGCTAGAAATAGCAAGTTA AAATAAGGCTAGTCCGTTATCAACTTGAAAAAGTGGCACCGAGTCG GTGCTTTT | 688 |
| 43029618 | 1 | GGGGTGACAATGGCT TGGAG | 434 | GGG | GGGGTGACAATGGCTTGGAGGTTTTAGAGCTAGAAATAGCAAGTTA AAATAAGGCTAGTCCGTTATCAACTTGAAAAAGTGGCACCGAGTCG GTGCTTTT | 689 |
| 43029621 | 1 | GTGACAATGGCTTGG AGGGG | 435 | TGG | GTGACAATGGCTTGGAGGGGGTTTTAGAGCTAGAAATAGCAAGTTA AAATAAGGCTAGTCCGTTATCAACTTGAAAAAGTGGCACCGAGTCG GTGCTTTT | 690 |
| 43029622 | 1 | TGACAATGGCTTGGA GGGGT | 436 | GGG | TGACAATGGCTTGGAGGGGTGTTTTAGAGCTAGAAATAGCAAGTTA AAATAAGGCTAGTCCGTTATCAACTTGAAAAAGTGGCACCGAGTCG GTGCTTTT | 691 |
| 43029632 | 1 | TTGGAGGGGTGGGTG AGTCA | 437 | AGG | TTGGAGGGGTGGGTGAGTCAGTTTTAGAGCTAGAAATAGCAAGTTA AAATAAGGCTAGTCCGTTATCAACTTGAAAAAGTGGCACCGAGTCG GTGCTTTT | 692 |
| 43029633 | 1 | TGGAGGGGTGGGTGA GTCAA | 438 | GGG | TGGAGGGGTGGGTGAGTCAAGTTTTAGAGCTAGAAATAGCAAGTTA AAATAAGGCTAGTCCGTTATCAACTTGAAAAAGTGGCACCGAGTCG GTGCTTTT | 693 |
| 43029656 | -1 | AGGCAGGCATCATGA CTCAC | 439 | GGG | AGGCAGGCATCATGACTCACGTTTTAGAGCTAGAAATAGCAAGTTA AAATAAGGCTAGTCCGTTATCAACTTGAAAAAGTGGCACCGAGTCG GTGCTTTT | 694 |
| 43029657 | -1 | AAGGCAGGCATCATG ACTCA | 440 | CGG | AAGGCAGGCATCATGACTCAGTTTTAGAGCTAGAAATAGCAAGTTA AAATAAGGCTAGTCCGTTATCAACTTGAAAAAGTGGCACCGAGTCG GTGCTTTT | 695 |
| 43029672 | -1 | AGTTATCAATTGTAC AAGGC | 441 | AGG | AGTTATCAATTGTACAAGGCGTTTTAGAGCTAGAAATAGCAAGTTA AAATAAGGCTAGTCCGTTATCAACTTGAAAAAGTGGCACCGAGTCG GTGCTTTT | 696 |
| 43029676 | -1 | GTTCAGTTATCAATT GTACA | 442 | AGG | GTTCAGTTATCAATTGTACAGTTTTAGAGCTAGAAATAGCAAGTTA AAATAAGGCTAGTCCGTTATCAACTTGAAAAAGTGGCACCGAGTCG GTGCTTTT | 697 |
| 43029692 | 1 | TACAATTGATAACTG AACAT | 443 | CGG | TACAATTGATAACTGAACATGTTTTAGAGCTAGAAATAGCAAGTTA AAATAAGGCTAGTCCGTTATCAACTTGAAAAAGTGGCACCGAGTCG GTGCTTTT | 698 |

TABLE 9-continued

| Genomic Coordinates of the Target Start Site in Genome Reference Consortium Human Build 37 (GRCh37): Chromosome 20 | Strand | Target sequence | SEQ ID NO | PAM | sgRNA sequence [PLEASE ADVISE, NO "Us"] | SEQ ID NO |
|---|---|---|---|---|---|---|
| 43029701 | 1 | TAACTGAACATCGGT GAGTT | 444 | AGG | TAACTGAACATCGGTGAGTTGTTTAGAGCTAGAAATAGCAAGTTA AAATAAGGCTAGTCCGTTATCAACTTGAAAAAGTGGCACCGAGTCG GTGCTTTT | 699 |
| 43029702 | 1 | AACTGAACATCGGTG AGTTA | 2511 | GGG | AACTGAACATCGGTGAGTTAGTTTAGAGCTAGAAATAGCAAGTTA AAATAAGGCTAGTCCGTTATCAACTTGAAAAAGTGGCACCGAGTCG GTGCTTTT | 700 |
| 43029714 | 1 | GGTGCTAATTACAAC TGCTG | 445 | GGG | GGTGCTAATTACAACTGCTGGTTTAGAGCTAGAAATAGCAAGTTA AAATAAGGCTAGTCCGTTATCAACTTGAAAAAGTGGCACCGAGTCG GTGCTTTT | 701 |
| 43029715 | -1 | GGGTGCTAATTACAA CTGCT | 446 | GGG | GGGTGCTAATTACAACTGCTGTTTAGAGCTAGAAATAGCAAGTTA AAATAAGGCTAGTCCGTTATCAACTTGAAAAAGTGGCACCGAGTCG GTGCTTTT | 702 |
| 43029716 | -1 | GGGGTGCTAATTACA ACTGC | 447 | TGG | GGGGTGCTAATTACAACTGCGTTTAGAGCTAGAAATAGCAAGTTA AAATAAGGCTAGTCCGTTATCAACTTGAAAAAGTGGCACCGAGTCG GTGCTTTT | 703 |
| 43029729 | -1 | AGCAGTTGTAATTAG CACCC | 448 | CGG | AGCAGTTGTAATTAGCACCCGTTTAGAGCTAGAAATAGCAAGTTA AAATAAGGCTAGTCCGTTATCAACTTGAAAAAGTGGCACCGAGTCG GTGCTTTT | 704 |
| 43029730 | 1 | GCAGTTGTAATTAGC ACCCC | 449 | GGG | GCAGTTGTAATTAGCACCCCGTTTAGAGCTAGAAATAGCAAGTTA AAATAAGGCTAGTCCGTTATCAACTTGAAAAAGTGGCACCGAGTCG GTGCTTTT | 705 |
| 43029735 | 1 | TGGTTTCTGGCTGAC ACCCG | 2512 | GGG | TGGTTTCTGGCTGACACCCGGTTTAGAGCTAGAAATAGCAAGTTA AAATAAGGCTAGTCCGTTATCAACTTGAAAAAGTGGCACCGAGTCG GTGCTTTT | 706 |
| 43029736 | -1 | TTCGTTTCTGGCTGA CACCC | 450 | GGG | TTGTTTCTGGCTGACACCCGTTTAGAGCTAGAAATAGCAAGTTA AAATAAGGCTAGTCCGTTATCAACTTGAAAAAGTGGCACCGAGTCG GTGCTTTT | 707 |
| 43029737 | -1 | GTTGGTTTCTGGCTG ACACC | 451 | CGG | GTTGGTTTCTGGCTGACACCGTTTAGAGCTAGAAATAGCAAGTTA AAATAAGGCTAGTCCGTTATCAACTTGAAAAAGTGGCACCGAGTCG GTGCTTTT | 708 |
| 43029748 | -1 | TTTTGGCTGTTGTTG GTTTC | 452 | TGG | TTTTGGCTGTTGTTGGTTTCGTTTAGAGCTAGAAATAGCAAGTTA AAATAAGGCTAGTCCGTTATCAACTTGAAAAAGTGGCACCGAGTCG GTGCTTTT | 709 |
| 43029755 | -1 | GCAGGGATTTGGCTG TTTGT | 453 | TGG | GCAGGGATTTGGCTGTTTGTGTTTAGAGCTAGAAATAGCAAGTTA AAATAAGGCTAGTCCGTTATCAACTTGAAAAAGTGGCACCGAGTCG GTGCTTTT | 710 |

TABLE 9-continued

| Genomic Coordinates of the Target Start Site in Genome Reference Consortium Human Build 37 (GRCh37): Chromosome 20 | Strand | Target sequence | SEQ ID NO | PAM | sgRNA sequence [NO "Us"] | SEQ ID NO |
|---|---|---|---|---|---|---|
| 43029766 | -1 | TGGGCGGGGCTGCAGGGATT | 454 | TGG | TGGGCGGGGCTGCAGGGATTGTTTTAGAGCTAGAAATAGCAAGTTAAAATAAGGCTAGTCCGTTATCAACTTGAAAAAGTGGCACCGAGTCGGTGCTTTT | 711 |
| 43029772 | -1 | ATAGGCTGGGCGGGGCTGCA | 455 | GGG | ATAGGCTGGGCGGGGCTGCAGTTTTAGAGCTAGAAATAGCAAGTTAAAATAAGGCTAGTCCGTTATCAACTTGAAAAAGTGGCACCGAGTCGGTGCTTTT | 712 |
| 43029773 | -1 | GATAGGCTGGGCGGGGCTGC | 456 | AGG | GATAGGCTGGGCGGGGCTGCGTTTTAGAGCTAGAAATAGCAAGTTAAAATAAGGCTAGTCCGTTATCAACTTGAAAAAGTGGCACCGAGTCGGTGCTTTT | 713 |
| 43029780 | -1 | GCCGGTGGATAGGCTGGGCG | 457 | GGG | GCCGGTGGATAGGCTGGGCGGTTTTAGAGCTAGAAATAGCAAGTTAAAATAAGGCTAGTCCGTTATCAACTTGAAAAAGTGGCACCGAGTCGGTGCTTTT | 714 |
| 43029781 | -1 | CGCCGGTGGATAGGCTGGGC | 458 | GGG | CGCCGGTGGATAGGCTGGGCGTTTTAGAGCTAGAAATAGCAAGTTAAAATAAGGCTAGTCCGTTATCAACTTGAAAAAGTGGCACCGAGTCGGTGCTTTT | 715 |
| 43029782 | -1 | CCGCCGGTGGATAGGCTGGG | 459 | CGG | CCGCCGGTGGATAGGCTGGGGTTTTAGAGCTAGAAATAGCAAGTTAAAATAAGGCTAGTCCGTTATCAACTTGAAAAAGTGGCACCGAGTCGGTGCTTTT | 716 |
| 43029785 | -1 | CCCCCGCCGGTGGATAGGCT | 460 | GGG | CCCCCGCCGGTGGATAGGCTGTTTTAGAGCTAGAAATAGCAAGTTAAAATAAGGCTAGTCCGTTATCAACTTGAAAAAGTGGCACCGAGTCGGTGCTTTT | 717 |
| 43029786 | -1 | TCCCCCGCCGGTGGATAGGC | 461 | TGG | TCCCCCGCCGGTGGATAGGCGTTTTAGAGCTAGAAATAGCAAGTTAAAATAAGGCTAGTCCGTTATCAACTTGAAAAAGTGGCACCGAGTCGGTGCTTTT | 718 |
| 43029790 | 1 | GCCCCGCCCAGCCTATCCAC | 462 | CGG | GCCCCGCCCAGCCTATCCACGTTTTAGAGCTAGAAATAGCAAGTTAAAATAAGGCTAGTCCGTTATCAACTTGAAAAAGTGGCACCGAGTCGGTGCTTTT | 719 |
| 43029790 | -1 | TCGGTCCCCCGCCGGTGGAT | 463 | AGG | TCGGTCCCCCGCCGGATGTTTTAGAGCTAGAAATAGCAAGTTAAAATAAGGCTAGTCCGTTATCAACTTGAAAAAGTGGCACCGAGTCGGTGCTTTT | 720 |
| 43029793 | 1 | CCGCCCAGCCTATCCACCGG | 464 | CGG | CCGCCCAGCCTATCCACCGGTTTTAGAGCTAGAAATAGCAAGTTAAAATAAGGCTAGTCCGTTATCAACTTGAAAAAGTGGCACCGAGTCGGTGCTTTT | 721 |

TABLE 9-continued

| Genomic Coordinates of the Target Start Site in Genome Reference Consortium Human Build 37 (GRCh37): Chromosome 20 | Strand | Target sequence | SEQ ID NO | PAM | sgRNA sequence [PLEASE ADVISE, NO "Us"] | SEQ ID NO |
|---|---|---|---|---|---|---|
| 43029794 | 1 | CGCCCAGCCTATCCACCCGGC | 465 | GGG | CGCCCAGCCTATCCACCGGCGTTTTAGAGCTAGAAATAGCAAGTTAAAATAAGGCTAGTCCGTTATCAACTTGAAAAAGTGGCACCGAGTCGGTGCTTTT | 722 |
| 43029795 | 1 | GCCCAGCCTATCCACCGGCG | 466 | GGG | GCCCAGCCTATCCACGGCGGTTTTAGAGCTAGAAATAGCAAGTTAAAATAAGGCTAGTCCGTTATCAACTTGAAAAAGTGGCACCGAGTCGGTGCTTTT | 723 |
| 43029795 | -1 | GTTAATCGGTCCCCCGCCGG | 467 | TGG | GTTAATCGGTCCCCCGCCGGTTTTAGAGCTAGAAATAGCAAGTTAAAATAAGGCTAGTCCGTTATCAACTTGAAAAAGTGGCACCGAGTCGGTGCTTTT | 724 |
| 43029796 | 1 | CCCAGCCTATCCACCGGCGG | 468 | GGG | CCCAGCCTATCCACCGGCGGTTTTAGAGCTAGAAATAGCAAGTTAAAATAAGGCTAGTCCGTTATCAACTTGAAAAAGTGGCACCGAGTCGGTGCTTTT | 725 |
| 43029798 | -1 | ATGGTTAATCGGTCCCCCGC | 2513 | CGG | ATGGTTAATCGGTCCCCCGCGTTTTAGAGCTAGAAATAGCAAGTTAAAATAAGGCTAGTCCGTTATCAACTTGAAAAAGTGGCACCGAGTCGGTGCTTTT | 726 |
| 43029809 | -1 | GGTGGGGTTAATGGTTAAT | 469 | CGG | GGTGGGGTTAATGTTAATGTTTAGAGCTAGAAATAGCAAGTTAAAATAAGGCTAGTCCGTTATCAACTTGAAAAAGTGGCACCGAGTCGGTGCTTTT | 727 |
| 43029817 | -1 | CGGGGAGGGGTGGGGTTAA | 470 | TGG | CGGGGAGGGGTGGGGTTAAGTTTTAGAGCTAGAAATAGCAAGTTAAAATAAGGCTAGTCCGTTATCAACTTGAAAAAGTGGCACCGAGTCGGTGCTTTT | 728 |
| 43029824 | -1 | GCTCTGCCCGGGAGGGGTGG | 471 | GGG | GCTCTGCCCGGGAGGGGTGGTTTTAGAGCTAGAAATAGCAAGTTAAAATAAGGCTAGTCCGTTATCAACTTGAAAAAGTGGCACCGAGTCGGTGCTTTT | 729 |
| 43029825 | -1 | GGCTCTGCCCGGGAGGGGTG | 472 | GGG | GGCTCTGCCCGGGAGGGTGTGTTTTAGAGCTAGAAATAGCAAGTTAAAATAAGGCTAGTCCGTTATCAACTTGAAAAAGTGGCACCGAGTCGGTGCTTTT | 730 |
| 43029826 | -1 | AGGCTCTGCCCGGGAGGGG | 473 | GGG | AGGCTCTGCCCGGGAGGGGTGTTTTAGAGCTAGAAATAGCAAGTTAAAATAAGGCTAGTCCGTTATCAACTTGAAAAAGTGGCACCGAGTCGGTGCTTTT | 731 |
| 43029827 | -1 | GAGGCTCTGCCCGGGAGGG | 474 | TGG | GAGGCTCTGCCCGGGAGGGGTTTTAGAGCTAGAAATAGCAAGTTAAAATAAGGCTAGTCCGTTATCAACTTGAAAAAGTGGCACCGAGTCGGTGCTTTT | 732 |
| 43029829 | 1 | CATTAACCCCCACCCCTCCC | 475 | CGG | CATTAACCCCCACCCCTCCCGTTTTAGAGCTAGAAATAGCAAGTTAAAATAAGGCTAGTCCGTTATCAACTTGAAAAAGTGGCACCGAGTCGGTGCTTTT | 733 |

TABLE 9-continued

| Genomic Coordinates of the Target Start Site in Genome Reference Consortium Human Build 37 (GRCh37): Chromosome 20) | Strand | Target sequence | SEQ ID NO | PAM | sgRNA sequence [PLEASE ADVISE, NO "Us"] | SEQ ID NO |
|---|---|---|---|---|---|---|
| 43029830 | -1 | GTGGAGGCTCTGCCG GGGAG | 476 | GGG | GTGGAGGCTCTGCCGGGGAGGTTTTAGAGCTAGAAATAGCAAGTTA AAATAAGGCTAGTCCGTTATCAACTTGAAAAAGTGGCACCGAGTCG GTGCTTTT | 734 |
| 43029831 | -1 | GGTGGAGGCTCTGCC GGGGA | 477 | GGG | GGTGGAGGCTCTGCCGGGGAGTTTTAGAGCTAGAAATAGCAAGTTA AAATAAGGCTAGTCCGTTATCAACTTGAAAAAGTGGCACCGAGTCG GTGCTTTT | 735 |
| 43029832 | -1 | GGGTGGAGGCTCTGC CGGGG | 478 | AGG | GGGTGGAGGCTCTGCCGGGGGTTTTAGAGCTAGAAATAGCAAGTTA AAATAAGGCTAGTCCGTTATCAACTTGAAAAAGTGGCACCGAGTCG GTGCTTTT | 736 |
| 43029835 | -1 | AAGGGGTGGAGGCTC TGCCG | 479 | GGG | AAGGGGTGGAGGCTCTGCCGGTTTTAGAGCTAGAAATAGCAAGTTA AAATAAGGCTAGTCCGTTATCAACTTGAAAAAGTGGCACCGAGTCG GTGCTTTT | 737 |
| 43029836 | -1 | GAAGGGGTGGAGGCT CTGCC | 480 | GGG | GAAGGGGTGGAGGCTCTGCCGTTTTAGAGCTAGAAATAGCAAGTTA AAATAAGGCTAGTCCGTTATCAACTTGAAAAAGTGGCACCGAGTCG GTGCTTTT | 738 |
| 43029837 | -1 | TGAAGGGGTGGAGGC TCTGC | 481 | CGG | TGAAGGGGTGGAGGCTCTGCGTTTTAGAGCTAGAAATAGCAAGTTA AAATAAGGCTAGTCCGTTATCAACTTGAAAAAGTGGCACCGAGTCG GTGCTTTT | 739 |
| 43029846 | -1 | TAGCCTCTGTGAAGG GGTGG | 482 | AGG | TAGCCTCTGTGAAGGGGTGGGTTTTAGAGCTAGAAATAGCAAGTTA AAATAAGGCTAGTCCGTTATCAACTTGAAAAAGTGGCACCGAGTCG GTGCTTTT | 740 |
| 43029849 | -1 | GCCTAGCCTCTGTGA AGGGG | 483 | TGG | GCCTAGCCTCTGTGAAGGGGGTTTTAGAGCTAGAAATAGCAAGTTA AAATAAGGCTAGTCCGTTATCAACTTGAAAAAGTGGCACCGAGTCG GTGCTTTT | 741 |
| 43029852 | -1 | TTGGCCTAGCCTCTG TGAAG | 484 | GGG | TTGGCCTAGCCTCTGTGAAGGTTTTAGAGCTAGAAATAGCAAGTTA AAATAAGGCTAGTCCGTTATCAACTTGAAAAAGTGGCACCGAGTCG GTGCTTTT | 742 |
| 43029853 | -1 | CTTGGCCTAGCCTCT GTGAA | 485 | GGG | CTTGGCCTAGCCTCTGTGAAGTTTTAGAGCTAGAAATAGCAAGTTA AAATAAGGCTAGTCCGTTATCAACTTGAAAAAGTGGCACCGAGTCG GTGCTTTT | 743 |
| 43029854 | 1 | GAGCCTCCACCCCTT CACAG | 486 | AGG | GAGCCTCCACCCCTTCACAGTTTTAGAGCTAGAAATAGCAAGTTA AAATAAGGCTAGTCCGTTATCAACTTGAAAAAGTGGCACCGAGTCG GTGCTTTT | 744 |

TABLE 9-continued

| Genomic Coordinates of the Target Start Site in Genome Reference Consortium Human Build 37 (GRCh37): Chromosome 20) | Strand | Target sequence | SEQ ID NO | PAM | sgRNA sequence [PLEASE ADVISE, NO "Us"] | SEQ ID NO |
|---|---|---|---|---|---|---|
| 43029854 | -1 | TCTTGGCCTAGCCTCTGTGA | 487 | AGG | TCTTGGCCTAGCCTCTGTGAGTTTTAGAGCTAGAAATAGCAAGTTAAAATAAGGCTAGTCCGTTATCAACTTGAAAAAGTGGCACCGAGTCGGTGCTTTT | 745 |
| 43029859 | 1 | TCCACCCCTTCACAGAGGCT | 488 | AGG | TCCACCCCTTCACAGAGGCTGTTTTAGAGCTAGAAATAGCAAGTTAAAATAAGGCTAGTCCGTTATCAACTTGAAAAAGTGGCACCGAGTCGGTGCTTTT | 746 |
| 43029871 | -1 | GGAAGATCTGCTGGGAGTCT | 489 | TGG | GGAAGATCTGCTGGGAGTCTGTTTTAGAGCTAGAAATAGCAAGTTAAAATAAGGCTAGTCCGTTATCAACTTGAAAAAGTGGCACCGAGTCGGTGCTTTT | 747 |
| 43029879 | -1 | GTCCTCTGGGAAGATCTGCT | 2514 | GGG | GTCCTCTGGGAAGATCTGCTGTTTTAGAGCTAGAAATAGCAAGTTAAAATAAGGCTAGTCCGTTATCAACTTGAAAAAGTGGCACCGAGTCGGTGCTTTT | 748 |
| 43029880 | -1 | CGTCCTCTGGGAAGATCTGC | 490 | TGG | CGTCCTCTGGGAAGATCTGCGTTTTAGAGCTAGAAATAGCAAGTTAAAATAAGGCTAGTCCGTTATCAACTTGAAAAAGTGGCACCGAGTCGGTGCTTTT | 749 |
| 43029888 | 1 | CTCCCAGCAGATCTTCCCAG | 491 | AGG | CTCCCAGCAGATCTTCCCAGGTTTTAGAGCTAGAAATAGCAAGTTAAAATAAGGCTAGTCCGTTATCAACTTGAAAAAGTGGCACCGAGTCGGTGCTTTT | 750 |
| 43029892 | 1 | CAGCAGATCTTCCCAGGAGA | 492 | CGG | CAGCAGATCTTCCCAGGAGAGTTTTAGAGCTAGAAATAGCAAGTTAAAATAAGGCTAGTCCGTTATCAACTTGAAAAAGTGGCACCGAGTCGGTGCTTTT | 751 |
| 43029892 | -1 | TTCCTTTCAAACCGTCCTCT | 493 | GGG | TTCCTTTCAAACCGTCCTCTGTTTTAGAGCTAGAAATAGCAAGTTAAAATAAGGCTAGTCCGTTATCAACTTGAAAAAGTGGCACCGAGTCGGTGCTTTT | 752 |
| 43029893 | -1 | CTTCCTTTCAAACCGTCCTC | 494 | TGG | CTTCCTTTCAAACCGTCCTCGTTTTAGAGCTAGAAATAGCAAGTTAAAATAAGGCTAGTCCGTTATCAACTTGAAAAAGTGGCACCGAGTCGGTGCTTTT | 753 |
| 43029901 | 1 | TTCCAGAGGACGGTTTGAA | 495 | AGG | TTCCAGAGGACGGTTTGAAGTTTTAGAGCTAGAAATAGCAAGTTAAAATAAGGCTAGTCCGTTATCAACTTGAAAAAGTGGCACCGAGTCGGTGCTTTT | 754 |
| 43029905 | 1 | CAGAGGACGCGTTTGAAAGGA | 496 | AGG | CAGAGGACGGTTTGAAAGGAGTTTTAGAGCTAGAAATAGCAAGTTAAAATAAGGCTAGTCCGTTATCAACTTGAAAAAGTGGCACCGAGTCGGTGCTTTT | 755 |
| 43029913 | 1 | GGTTTGAAAGGAAGGCAGAG | 2515 | AGG | GGTTTGAAAGGAAGGCAGAGGTTTTAGAGCTAGAAATAGCAAGTTAAAATAAGGCTAGTCCGTTATCAACTTGAAAAAGTGGCACCGAGTCGGTGCTTTT | 756 |

TABLE 9-continued

| Genomic Coordinates of the Target Start Site in Genome Reference Consortium Human Build 37 (GRCh37): Chromosome 20) | Strand | Target sequence | SEQ ID NO | PAM | sgRNA sequence [PLEASE ADVISE, NO "Us"] | SEQ ID NO |
|---|---|---|---|---|---|---|
| 43029914 | 1 | GTTTGAAGGAAGGC AGAGA | 497 | GGG | GTTTGAAGGAAGGCAGAGAGTTTTAGAGCTAGAAATAGCAAGTTA AAATAAGGCTAGTCCGTTATCAACTTGAAAAAGTGGCACCGAGTCG GTGCTTTT | 757 |
| 43029920 | 1 | AAGGAAGGCAGAGAG GGCAC | 498 | TGG | AAGGAAGGCAGAGAGGGCACGTTTTAGAGCTAGAAATAGCAAGTTA AAATAAGGCTAGTCCGTTATCAACTTGAAAAAGTGGCACCGAGTCG GTGCTTTT | 758 |
| 43029921 | 1 | AGGAAGGCAGAGAGG GCACT | 499 | GGG | AGGAAGGCAGAGAGGGCACTGTTTTAGAGCTAGAAATAGCAAGTTA AAATAAGGCTAGTCCGTTATCAACTTGAAAAAGTGGCACCGAGTCG GTGCTTTT | 759 |
| 43029924 | 1 | AAGGCAGAGAGGGCA CTGGG | 500 | AGG | AAGGCAGAGAGGGCACTGGGGTTTTAGAGCTAGAAATAGCAAGTTA AAATAAGGCTAGTCCGTTATCAACTTGAAAAAGTGGCACCGAGTCG GTGCTTTT | 760 |
| 43029927 | 1 | GCAGAGAGGGCACTG GGAGG | 501 | AGG | GCAGAGAGGGCACTGGGAGGGTTTTAGAGCTAGAAATAGCAAGTTA AAATAAGGCTAGTCCGTTATCAACTTGAAAAAGTGGCACCGAGTCG GTGCTTTT | 761 |
| 43029933 | 1 | AGGGCACTGGGAGGA GGCAG | 502 | TGG | AGGGCACTGGGAGGAGGCAGTGTTTTAGAGCTAGAAATAGCAAGTTA AAATAAGGCTAGTCCGTTATCAACTTGAAAAAGTGGCACCGAGTCG GTGCTTTT | 762 |
| 43029934 | 1 | GGGCACTGGGAGGAGGCAGT | 503 | GGG | GGGCACTGGGAGGAGGCAGTGTTTTAGAGCTAGAAATAGCAAGTTA AAATAAGGCTAGTCCGTTATCAACTTGAAAAAGTGGCACCGAGTCG GTGCTTTT | 763 |
| 43029937 | 1 | CACTGGGAGGAGGCA GTGGG | 504 | AGG | CACTGGGAGGAGGCAGTGGGTTTTAGAGCTAGAAATAGCAAGTTA AAATAAGGCTAGTCCGTTATCAACTTGAAAAAGTGGCACCGAGTCG GTGCTTTT | 764 |
| 43029938 | 1 | ACTGGGAGGAGGCAG TGGGA | 505 | GGG | ACTGGGAGGAGGCAGTGGGAGTTTTAGAGCTAGAAATAGCAAGTTA AAATAAGGCTAGTCCGTTATCAACTTGAAAAAGTGGCACCGAGTCG GTGCTTTT | 765 |
| 43029941 | 1 | GGGAGGAGGCAGTGG GAGGG | 506 | CGG | GGGAGGAGGCAGTGGGAGGGGTTTTAGAGCTAGAAATAGCAAGTTA AAATAAGGCTAGTCCGTTATCAACTTGAAAAAGTGGCACCGAGTCG GTGCTTTT | 766 |
| 43029944 | 1 | AGGAGGCAGTGGGAG GGCGG | 507 | AGG | AGGAGGCAGTGGGAGGGCGGTTTTAGAGCTAGAAATAGCAAGTTA AAATAAGGCTAGTCCGTTATCAACTTGAAAAAGTGGCACCGAGTCG GTGCTTTT | 767 |

TABLE 9-continued

| Genomic Coordinates of the Target Start Site in Genome Reference Consortium Human Build 37 (GRCh37): Chromosome 20) | Strand | Target sequence | SEQ ID NO | PAM | sgRNA sequence [PLEASE ADVISE, NO "Us"] | SEQ ID NO |
|---|---|---|---|---|---|---|
| 43029945 | 1 | GGAGGCAGTGGGAGGGCGGA | 508 | GGG | GGAGGCAGTGGGAGGGCGGAGTTTTAGAGCTAGAAATAGCAAGTTAAAATAAGGCTAGTCCGTTATCAACTTGAAAAAGTGGCACCGAGTCGGTGCTTTT | 768 |
| 43029948 | 1 | GGCAGTGGGAGGGCGGAGGG | 509 | CGG | GGCAGTGGGAGGGCGGAGGGTTTTAGAGCTAGAAATAGCAAGTTAAAATAAGGCTAGTCCGTTATCAACTTGAAAAAGTGGCACCGAGTCGGTGCTTTT | 769 |
| 43029949 | 1 | GCAGTGGGAGGGCGGAGGGC | 510 | GGG | GCAGTGGGAGGGCGGAGGGCGTTTTAGAGCTAGAAATAGCAAGTTAAAATAAGGCTAGTCCGTTATCAACTTGAAAAAGTGGCACCGAGTCGGTGCTTTT | 770 |
| 43029950 | 1 | CAGTGGGAGGGCGGAGGGCG | 511 | GGG | CAGTGGGAGGGCGGAGGGCGGTTTTAGAGCTAGAAATAGCAAGTTAAAATAAGGCTAGTCCGTTATCAACTTGAAAAAGTGGCACCGAGTCGGTGCTTTT | 771 |
| 43029951 | 1 | AGTGGGAGGGCGGAGGGCGG | 512 | GGG | AGTGGGAGGGCGGAGGGCGGGTTTTAGAGCTAGAAATAGCAAGTTAAAATAAGGCTAGTCCGTTATCAACTTGAAAAAGTGGCACCGAGTCGGTGCTTTT | 772 |
| 43029958 | 1 | GGGCGGAGGGCGGGGGCCTT | 513 | CGG | GGGCGGAGGGCGGGGGCCTTGTTTTAGAGCTAGAAATAGCAAGTTAAAATAAGGCTAGTCCGTTATCAACTTGAAAAAGTGGCACCGAGTCGGTGCTTTT | 773 |
| 43029959 | 1 | GGCGGAGGGCGGGGGCCTTC | 514 | GGG | GGCGGAGGGCGGGGGCCTTCGTTTTAGAGCTAGAAATAGCAAGTTAAAATAAGGCTAGTCCGTTATCAACTTGAAAAAGTGGCACCGAGTCGGTGCTTTT | 774 |
| 43029960 | 1 | GCGGAGGGCGGGGGCCTTCG | 515 | GGG | GCGGAGGGCGGGGGCCTTCGGTTTTAGAGCTAGAAATAGCAAGTTAAAATAAGGCTAGTCCGTTATCAACTTGAAAAAGTGGCACCGAGTCGGTGCTTTT | 775 |
| 43029963 | 1 | GAGGGCGGGGGCCTTCGGGG | 516 | TGG | GAGGGCGGGGGCCTTCGGGGTTTTAGAGCTAGAAATAGCAAGTTAAAATAAGGCTAGTCCGTTATCAACTTGAAAAAGTGGCACCGAGTCGGTGCTTTT | 776 |
| 43029963 | −1 | ACCCTGGCGCGCCCACCCCGA | 2516 | AGG | ACCCTGGCGCGCCCACCCCGAGTTTTAGAGCTAGAAATAGCAAGTTAAAATAAGGCTAGTCCGTTATCAACTTGAAAAAGTGGCACCGAGTCGGTGCTTTT | 777 |
| 43029964 | 1 | AGGGCGGGGGCCTTCGGGGT | 517 | GGG | AGGGCGGGGGCCTTCGGGGTGTTTTAGAGCTAGAAATAGCAAGTTAAAATAAGGCTAGTCCGTTATCAACTTGAAAAAGTGGCACCGAGTCGGTGCTTTT | 778 |
| 43029972 | 1 | GGCCTTCGGGGTGGGCGCCC | 518 | AGG | GGCCTTCGGGGTGGGCGCCCCGTTTTAGAGCTAGAAATAGCAAGTTAAAATAAGGCTAGTCCGTTATCAACTTGAAAAAGTGGCACCGAGTCGGTGCTTTT | 779 |

TABLE 9-continued

| Genomic Coordinates of the Target Start Site in Genome Reference Consortium Human Build 37 (GRCh37): Chromosome 20) | Strand | Target sequence | SEQ ID NO | PAM | sgRNA sequence [PLEASE ADVISE, NO "Us"] | SEQ ID NO |
|---|---|---|---|---|---|---|
| 43029973 | 1 | GCCTTCGGGGTGGGCGCCCA | 519 | GGG | GCCTTCGGGGTGGGCGCCCAGTTTTAGAGCTAGAAATAGCAAGTTAAAATAAGGCTAGTCCGTTATCAACTTGAAAAAGTGGCACCGAGTCGGTGCTTTT | 780 |
| 43029977 | 1 | TCGGGGTGGGCGCCCAGGGT | 2517 | AGG | TCGGGGTGGGCGCCCAGGGTGTTTTAGAGCTAGAAATAGCAAGTTAAAATAAGGCTAGTCCGTTATCAACTTGAAAAAGTGGCACCGAGTCGGTGCTTTT | 781 |
| 43029978 | 1 | CGGGGTGGGCGCCCAGGGTA | 520 | GGG | CGGGGTGGGCGCCCAGGGTAGTTTTAGAGCTAGAAATAGCAAGTTAAAATAAGGCTAGTCCGTTATCAACTTGAAAAAGTGGCACCGAGTCGGTGCTTTT | 782 |
| 43029978 | -1 | GCGGCCCACCTGCCCTACCCT | 521 | GGG | GCGGCCCACCTGCCCTACCCTGTTTTAGAGCTAGAAATAGCAAGTTAAAATAAGGCTAGTCCGTTATCAACTTGAAAAAGTGGCACCGAGTCGGTGCTTTT | 783 |
| 43029979 | -1 | CGGGGCCACCTGCCCTACCC | 522 | TGG | CGGCGCCACCTGCCCTACCCGTTTTAGAGCTAGAAATAGCAAGTTAAAATAAGGCTAGTCCGTTATCAACTTGAAAAAGTGGCACCGAGTCGGTGCTTTT | 784 |
| 43029982 | 1 | GTGGGCGCCCAGGGTAGGGC | 523 | AGG | GTGGGCGCCCAGGGTAGGGCGTTTTAGAGCTAGAAATAGCAAGTTAAAATAAGGCTAGTCCGTTATCAACTTGAAAAAGTGGCACCGAGTCGGTGCTTTT | 785 |
| 43029985 | 1 | GGCGCCCAGGGTAGGGCAGG | 524 | TGG | GGCGCCCAGGGTAGGGCAGGGTTTTAGAGCTAGAAATAGCAAGTTAAAATAAGGCTAGTCCGTTATCAACTTGAAAAAGTGGCACCGAGTCGGTGCTTTT | 786 |
| 43029991 | 1 | CAGGGTAGGGCAGGTGGCCG | 525 | CGG | CAGGGTAGGGCAGGTGGCCGGTTTTAGAGCTAGAAATAGCAAGTTAAAATAAGGCTAGTCCGTTATCAACTTGAAAAAGTGGCACCGAGTCGGTGCTTTT | 787 |
| 43029996 | 1 | TAGGGCAGGTGGCCGCGGCG | 526 | TGG | TAGGCAGGTGGCCGCGGCGGTTTTAGAGCTAGAAATAGCAAGTTAAAATAAGGCTAGTCCGTTATCAACTTGAAAAAGTGGCACCGAGTCGGTGCTTTT | 788 |
| 43029997 | -1 | TTCTCCCTGCCTCCACGCCG | 2518 | CGG | TTCTCCCTGCCTCCACGCCGGTTTTAGAGCTAGAAATAGCAAGTTAAAATAAGGCTAGTCCGTTATCAACTTGAAAAAGTGGCACCGAGTCGGTGCTTTT | 789 |
| 43029999 | 1 | GGCAGGTGGCCGCGGCGTGG | 527 | AGG | GGCAGGTGCCGCGGCGTGGGTTTTAGAGCTAGAAATAGCAAGTTAAAATAAGGCTAGTCCGTTATCAACTTGAAAAAGTGGCACCGAGTCGGTGCTTTT | 790 |

TABLE 9-continued

| Genomic Coordinates of the Target Start Site in Genome Reference Consortium Human Build 37 (GRCh37): Chromosome 20 | Strand | Target sequence | SEQ ID NO | PAM | sgRNA sequence [PLEASE ADVISE, NO "Us"] | SEQ ID NO |
|---|---|---|---|---|---|---|
| 43030003 | 1 | GGTGGCCGCGGCCGTGGAGGC | 528 | AGG | GGTGCCGCCGCGTGGAGGCGTTTTAGAGCTAGAAATAGCAAGTTAAAATAAGGCTAGTCCGTTATCAACTTGAAAAAGTGGCACCGAGTCGGTGCTTTT | 791 |
| 43030004 | 1 | GTGGCCGCGGCCGTGGAGGCA | 529 | GGG | GTGGCCGCGGCCGTGGAGGCAGTTTTAGAGCTAGAAATAGCAAGTTAAAATAAGGCTAGTCCGTTATCAACTTGAAAAAGTGGCACCGAGTCGGTGCTTTT | 792 |
| 43030029 | -1 | GTCCATGTCGACGAGGGTTT | 530 | TGG | GTCCATGTCGACGAGGGTTTGTTTTAGAGCTAGAAATAGCAAGTTAAAATAAGGCTAGTCCGTTATCAACTTGAAAAAGTGGCACCGAGTCGGTGCTTTT | 793 |
| 43030035 | -1 | GGCCATGTCCATGTCGACCA | 531 | GGG | GGCCATGTCCATGTCGACAGTTTTAGAGCTAGAAATAGCAAGTTAAAATAAGGCTAGTCCGTTATCAACTTGAAAAAGTGGCACCGAGTCGGTGCTTTT | 794 |
| 43030036 | -1 | CGGCCATGTCCATGTCGACG | 532 | AGG | CGGCCATGTCCATGTCGACGGTTTTAGAGCTAGAAATAGCAAGTTAAAATAAGGCTAGTCCGTTATCAACTTGAAAAAGTGGCACCGAGTCGGTGCTTTT | 795 |
| 43030038 | 1 | CTCCAAAACCCTCGTCGACA | 533 | TGG | CTCCAAAACCCTCGCGACAGTTTTAGAGCTAGAAATAGCAAGTTAAAATAAGGCTAGTCCGTTATCAACTTGAAAAAGTGGCACCGAGTCGGTGCTTTT | 796 |
| 43030044 | 1 | AACCCTCGTCGACATGGACA | 534 | TGG | AACCCTCGTCGACATGGACAGTTTTAGAGCTAGAAATAGCAAGTTAAAATAAGGCTAGTCCGTTATCAACTTGAAAAAGTGGCACCGAGTCGGTGCTTTT | 797 |
| 43030056 | -1 | GTCCAGTGCAGCACTGTAGT | 535 | CGG | GTCCAGTGCAGCACTGTAGTGTTTTAGAGCTAGAAATAGCAAGTTAAAATAAGGCTAGTCCGTTATCAACTTGAAAAAGTGGCACCGAGTCGGTGCTTTT | 798 |
| 43030065 | 1 | GGCCGACTACAGTGCTGCAC | 536 | TGG | GGCCGACTACAGTGCTGCACGTTTTAGAGCTAGAAATAGCAAGTTAAAATAAGGCTAGTCCGTTATCAACTTGAAAAAGTGGCACCGAGTCGGTGCTTTT | 799 |
| 43030078 | -1 | ATTCCAGGGTGGTGTAGGCT | 537 | GGG | ATTCCAGGGTGGTGTAGGCTGTTTTAGAGCTAGAAATAGCAAGTTAAAATAAGGCTAGTCCGTTATCAACTTGAAAAAGTGGCACCGAGTCGGTGCTTTT | 800 |
| 43030079 | -1 | AATTCCAGGGTGGTGTAGGC | 538 | TGG | AATTCCAGGGTGGTGTAGGCGTTTTAGAGCTAGAAATAGCAAGTTAAAATAAGGCTAGTCCGTTATCAACTTGAAAAAGTGGCACCGAGTCGGTGCTTTT | 801 |
| 43030083 | -1 | CTCAAATTCCAGGGTGGTGT | 539 | AGG | CTCAAATTCCAGGGTGGTGTTTTTAGAGCTAGAAATAGCAAGTTAAAATAAGGCTAGTCCGTTATCAACTTGAAAAAGTGGCACCGAGTCGGTGCTTTT | 802 |

TABLE 9-continued

| Genomic Coordinates of the Target Start Site in Genome Reference Consortium Human Build 37 (GRCh37): Chromosome 20) | Strand | Target sequence | SEQ ID NO | PAM | sgRNA sequence [PLEASE ADVISE, NO "Us"] | SEQ ID NO |
|---|---|---|---|---|---|---|
| 43030086 | 1 | GGACCCAGCCTACCACCACCCC | 540 | TGG | GGACCCAGCCTACCACCACCCGTTTTAGAGCTAGAAATAGCAAGTTAAAATAAGGCTAGTCCGTTATCAACTTGAAAAAGTGGCACCGAGTCGGTGCTTTT | 803 |
| 43030089 | -1 | CACATTCTCAAATTCCAGGG | 541 | TGG | CACATTCTCAAATTCCAGGGGTTTTAGAGCTAGAAATAGCAAGTTAAAATAAGGCTAGTCCGTTATCAACTTGAAAAAGTGGCACCGAGTCGGTGCTTTT | 804 |
| 43030092 | -1 | CTGCACATTCTCAAATTCCA | 542 | GGG | CTGCACATTCTCAAATTCCAGTTTTAGAGCTAGAAATAGCAAGTTAAAATAAGGCTAGTCCGTTATCAACTTGAAAAAGTGGCACCGAGTCGGTGCTTTT | 805 |
| 43030093 | -1 | CCTGCACATTCTCAAATTCC | 543 | AGG | CCTGCACATTCTCAAATTCCGTTTTAGAGCTAGAAATAGCAAGTTAAAATAAGGCTAGTCCGTTATCAACTTGAAAAAGTGGCACCGAGTCGGTGCTTTT | 806 |
| 43030104 | 1 | CCTGGAATTTGAGAATGTGC | 544 | AGG | CCTGGAATTTGAGAATGTGCGTTTTAGAGCTAGAAATAGCAAGTTAAAATAAGGCTAGTCCGTTATCAACTTGAAAAAGTGGCACCGAGTCGGTGCTTTT | 807 |
| 43030116 | 1 | GAATGTGCAGGTGTTGACGA | 545 | TGG | GAATGTGCAGGTGTTGACGAGTTTTAGAGCTAGAAATAGCAAGTTAAAATAAGGCTAGTCCGTTATCAACTTGAAAAAGTGGCACCGAGTCGGTGCTTTT | 808 |
| 43030117 | 1 | AATGTGCAGGTGTTGACGAT | 546 | GGG | AATGTGCAGGTGTTGACGATGTTTTAGAGCTAGAAATAGCAAGTTAAAATAAGGCTAGTCCGTTATCAACTTGAAAAAGTGGCACCGAGTCGGTGCTTTT | 809 |
| 43030123 | 1 | CAGGTGTTGACGATGGGCAA | 547 | TGG | CAGGTGTTGACGATGGGCAAGTTTTAGAGCTAGAAATAGCAAGTTAAAATAAGGCTAGTCCGTTATCAACTTGAAAAAGTGGCACCGAGTCGGTGCTTTT | 810 |
| 43030127 | 1 | TGTTGACGATGGGCAATGGT | 548 | AGG | TGTTGACGATGGGCAATGGTGTTTTAGAGCTAGAAATAGCAAGTTAAAATAAGGCTAGTCCGTTATCAACTTGAAAAAGTGGCACCGAGTCGGTGCTTTT | 811 |
| 43030130 | 1 | TGACGATGGGCAATGGTAGG | 549 | TGG | TGACGATGGGCAATGGTAGGGTTTTAGAGCTAGAAATAGCAAGTTAAAATAAGGCTAGTCCGTTATCAACTTGAAAAAGTGGCACCGAGTCGGTGCTTTT | 812 |
| 43030131 | 1 | GACGATGGGCAATGGTAGGT | 550 | GGG | GACGATGGGCAATGGTAGGTGTTTTAGAGCTAGAAATAGCAAGTTAAAATAAGGCTAGTCCGTTATCAACTTGAAAAAGTGGCACCGAGTCGGTGCTTTT | 813 |

TABLE 9-continued

| Genomic Coordinates of the Target Start Site in Genome Reference Consortium Human Build 37 (GRCh37): Chromosome 20) | Strand | Target sequence | SEQ ID NO | PAM | sgRNA sequence [PLEASE ADVISE, NO "Us"] | SEQ ID NO |
|---|---|---|---|---|---|---|
| 43030132 | 1 | ACGATGGGCAATGTGTAGGTG | 551 | GGG | ACGATGGGCAATGTGTAGGTGTTTAGAGCTAGAAATAGCAAGTTAAAATAAGGCTAGTCCGTTATCAACTTGAAAAAGTGGCACCGAGTCGGTGCTTTT | 814 |
| 43030133 | 1 | CGATGGGCAATGTGTAGGTGG | 552 | GGG | CGATGGGCAATGTGTAGGTGGTTTAGAGCTAGAAATAGCAAGTTAAAATAAGGCTAGTCCGTTATCAACTTGAAAAAGTGGCACCGAGTCGGTGCTTTT | 815 |
| 43030147 | 1 | AGGTGGGGCAGATGTGCCCC | 553 | AGG | AGGTGGGGCAGATGTGCCCGTTTTAGAGCTAGAAATAGCAAGTTAAAATAAGGCTAGTCCGTTATCAACTTGAAAAAGTGGCACCGAGTCGGTGCTTTT | 816 |
| 43030153 | -1 | CTGCCCCCACTGGCACACCT | 554 | GGG | CTGCCCCACTGGCACACCTGTTTTAGAGCTAGAAATAGCAAGTTAAAATAAGGCTAGTCCGTTATCAACTTGAAAAAGTGGCACCGAGTCGGTGCTTTT | 817 |
| 43030154 | -1 | CCTGCCCCACTGGCACACC | 555 | TGG | CCTGCCCCACTGGCACACCGTTTTAGAGCTAGAAATAGCAAGTTAAAATAAGGCTAGTCCGTTATCAACTTGAAAAAGTGGCACCGAGTCGGTGCTTTT | 818 |
| 43030158 | 1 | GATGTGCCCAGGTGTGCCAG | 556 | TGG | GATGTGCCAGGTGTGCCAGTGTTTTAGAGCTAGAAATAGCAAGTTAAAATAAGGCTAGTCCGTTATCAACTTGAAAAAGTGGCACCGAGTCGGTGCTTTT | 819 |
| 43030159 | 1 | ATGTGCCCAGGTGTGCCAGT | 557 | GGG | ATGTGCCAGGTGTGCCAGTGTTTTAGAGCTAGAAATAGCAAGTTAAAATAAGGCTAGTCCGTTATCAACTTGAAAAAGTGGCACCGAGTCGGTGCTTTT | 820 |
| 43030160 | 1 | TGTGCCCAGGTGTGCCAGTG | 558 | GGG | TGTGCCCAGGTGTGCCAGTGGTTTTAGAGCTAGAAATAGCAAGTTAAAATAAGGCTAGTCCGTTATCAACTTGAAAAAGTGGCACCGAGTCGGTGCTTTT | 821 |
| 43030161 | 1 | GTGCCCAGGTGTGCCAGTGG | 559 | GGG | GTGCCCAGGTGTGCCAGTGGGTTTTAGAGCTAGAAATAGCAAGTTAAAATAAGGCTAGTCCGTTATCAACTTGAAAAAGTGGCACCGAGTCGGTGCTTTT | 822 |
| 43030163 | -1 | CCAGGCACACCTGCCCCAC | 560 | TGG | CCAGGCACACCTGCCCCCACGTTTTAGAGCTAGAAATAGCAAGTTAAAATAAGGCTAGTCCGTTATCAACTTGAAAAAGTGGCACCGAGTCGGTGCTTTT | 823 |
| 43030165 | 1 | CCAGGTGTGCCAGTGGGGC | 561 | AGG | CCAGGTGTGCCAGTGGGGGCGTTTTAGAGCTAGAAATAGCAAGTTAAAATAAGGCTAGTCCGTTATCAACTTGAAAAAGTGGCACCGAGTCGGTGCTTTT | 824 |
| 43030174 | 1 | CCAGTGGGGCAGGTGTGCC | 562 | TGG | CCAGTGGGGCAGGTGTGCCGTTATCAACTTGAAAAAGTGGCACCGAGTCGGTGCTTTTTTAGAGCTAGAAATAGCAAGTTAAAATAAGGCTAGTCCGTTATCAACTTGAAAAAGTGGCACCGAGTCGGTGCTTTT | 825 |

TABLE 9-continued

| Genomic Coordinates of the Target Start Site in Genome Reference Consortium Human Build 37 (GRCh37): Chromosome 20 | Strand | Target sequence | SEQ ID NO | PAM | sgRNA sequence [PLEASE ADVISE, NO "Us"] | SEQ ID NO |
|---|---|---|---|---|---|---|
| 43030175 | 1 | CAGTGGGGCAGGTGTGCCT | 563 | GGG | CAGTGGGGCAGGTGTGCCTGTTTTAGAGCTAGAAATAGCAAGTTAAAATAAGGCTAGTCCGTTATCAACTTGAAAAAGTGGCACCGAGTCGGTGCTTTT | 826 |
| 43030181 | 1 | GGGCAGGTGTGCCTGGGTCC | 564 | AGG | GGGCAGGTGTGCCTGGGTCCGTTTTAGAGCTAGAAATAGCAAGTTAAAATAAGGCTAGTCCGTTATCAACTTGAAAAAGTGGCACCGAGTCGGTGCTTTT | 827 |
| 43030181 | -1 | AAAGATCTGCTCCTGGACCC | 565 | AGG | AAAGATCTGCTCCTGGACCCGTTTTAGAGCTAGAAATAGCAAGTTAAAATAAGGCTAGTCCGTTATCAACTTGAAAAAGTGGCACCGAGTCGGTGCTTTT | 828 |
| 43030188 | -1 | GAGTGCCAAAGATCTGCTCC | 566 | TGG | GAGTGCCAAAGATCTGCTCCGTTTTAGAGCTAGAAATAGCAAGTTAAAATAAGGCTAGTCCGTTATCAACTTGAAAAAGTGGCACCGAGTCGGTGCTTTT | 829 |
| 43030194 | 1 | TGGGTCCAGGAGCAGATCTT | 567 | TGG | TGGGTCCAGGAGCAGATCTTGTTTTAGAGCTAGAAATAGCAAGTTAAAATAAGGCTAGTCCGTTATCAACTTGAAAAAGTGGCACCGAGTCGGTGCTTTT | 830 |
| 43030207 | 1 | AGATCTTTGGCACTCAACTT | 568 | TGG | AGATCTTTGGCACTCAACTTGTTTTAGAGCTAGAAATAGCAAGTTAAAATAAGGCTAGTCCGTTATCAACTTGAAAAAGTGGCACCGAGTCGGTGCTTTT | 831 |
| 43030208 | 1 | GATCTTTGGCACTCAACTTT | 569 | GGG | GATCTTTGGCACTCAACTTTGTTTTAGAGCTAGAAATAGCAAGTTAAAATAAGGCTAGTCCGTTATCAACTTGAAAAAGTGGCACCGAGTCGGTGCTTTT | 832 |
| 43030209 | 1 | ATCTTTGGCACTCAACTTTG | 570 | GGG | ATCTTTGGCACTCAACTTTGGTTTTAGAGCTAGAAATAGCAAGTTAAAATAAGGCTAGTCCGTTATCAACTTGAAAAAGTGGCACCGAGTCGGTGCTTTT | 833 |
| 43030212 | 1 | TTTGGCACTCAACTTTGGGG | 571 | TGG | TTTGGCACTCAACTTTGGGGGTTTTAGAGCTAGAAATAGCAAGTTAAAATAAGGCTAGTCCGTTATCAACTTGAAAAAGTGGCACCGAGTCGGTGCTTTT | 834 |
| 43030213 | 1 | TTGGCACTCAACTTTGGGGT | 572 | GGG | TTGGCACTCAACTTTGGGGTGTTTTAGAGCTAGAAATAGCAAGTTAAAATAAGGCTAGTCCGTTATCAACTTGAAAAAGTGGCACCGAGTCGGTGCTTTT | 835 |
| 43030216 | 1 | GCACTCAACTTTGGGGTGGG | 573 | AGG | GCACTCAACTTTGGGGTGGGGTTTTAGAGCTAGAAATAGCAAGTTAAAATAAGGCTAGTCCGTTATCAACTTGAAAAAGTGGCACCGAGTCGGTGCTTTT | 836 |

TABLE 9-continued

| Genomic Coordinates of the Target Start Site in Genome Reference Consortium Human Build 37 (GRCh37): Chromosome 20 | Strand | Target sequence | SEQ ID NO | PAM | sgRNA sequence [PLEASE ADVISE, NO "Us"] | SEQ ID NO |
|---|---|---|---|---|---|---|
| 43030233 | 1 | GGGAGGAGAATGATACAAAA | 574 | TGG | GGGAGGAGAATGATACAAAAGTTTTAGAGCTAGAAATAGCAAGTTAAAATAAGGCTAGTCCGTTATCAACTTGAAAAAGTGGCACCGAGTCGGTGCTTTT | 837 |
| 43030237 | 1 | GGAGAATGATACAAAATGGT | 575 | AGG | GGAGAATGATACAAAATGGTGTTTTAGAGCTAGAAATAGCAAGTTAAAATAAGGCTAGTCCGTTATCAACTTGAAAAAGTGGCACCGAGTCGGTGCTTTT | 838 |
| 43030241 | 1 | AATGATACAAAATGGTAGGT | 576 | TGG | AATGATACAAAATGGTAGGTGTTTTAGAGCTAGAAATAGCAAGTTAAAATAAGGCTAGTCCGTTATCAACTTGAAAAAGTGGCACCGAGTCGGTGCTTTT | 839 |
| 43030250 | 1 | AAATGGTAGGTTGGTCCTAC | 577 | AGG | AAATGGTAGGTTGGTCCTACGTTTTAGAGCTAGAAATAGCAAGTTAAAATAAGGCTAGTCCGTTATCAACTTGAAAAAGTGGCACCGAGTCGGTGCTTTT | 840 |
| 43030254 | -1 | CAACACCTGTGCTGGCCTGT | 578 | AGG | CAACACCTGTGCTGGCCTGTGTTTTAGAGCTAGAAATAGCAAGTTAAAATAAGGCTAGTCCGTTATCAACTTGAAAAAGTGGCACCGAGTCGGTGCTTTT | 841 |
| 43030260 | 1 | TTGGTCCTACAGGCCAGCAC | 579 | AGG | TTGGTCCTACAGGCCAGCACGTTTTAGAGCTAGAAATAGCAAGTTAAAATAAGGCTAGTCCGTTATCAACTTGAAAAAGTGGCACCGAGTCGGTGCTTTT | 842 |
| 43030262 | -1 | TCACTTGGCAACACCTGTGC | 580 | TGG | TCACTTGGCAACACCTGTGCGTTTTAGAGCTAGAAATAGCAAGTTAAAATAAGGCTAGTCCGTTATCAACTTGAAAAAGTGGCACCGAGTCGGTGCTTTT | 843 |
| 43030277 | -1 | CTGGGCACATGGGCTTCACT | 581 | TGG | CTGGGCACATGGGCTTCACTGTTTTAGAGCTAGAAATAGCAAGTTAAAATAAGGCTAGTCCGTTATCAACTTGAAAAAGTGGCACCGAGTCGGTGCTTTT | 844 |
| 43030287 | -1 | ATCACTGTGCCTGGGCACAT | 582 | GGG | ATCACTGTGCCTGGGCACATGTTTTAGAGCTAGAAATAGCAAGTTAAAATAAGGCTAGTCCGTTATCAACTTGAAAAAGTGGCACCGAGTCGGTGCTTTT | 845 |
| 43030288 | -1 | GATCACTGTGCCTGGGCACA | 583 | TGG | GATCACTGTGCCTGGGCACAGTTTTAGAGCTAGAAATAGCAAGTTAAAATAAGGCTAGTCCGTTATCAACTTGAAAAAGTGGCACCGAGTCGGTGCTTTT | 846 |
| 43030289 | 1 | CAAGTGAAGCCCATGTGCCC | 584 | AGG | CAAGTGAAGCCCATGTGCCCGTTTTAGAGCTAGAAATAGCAAGTTAAAATAAGGCTAGTCCGTTATCAACTTGAAAAAGTGGCACCGAGTCGGTGCTTTT | 847 |
| 43030295 | -1 | TGCCTGTGATCACTGTGCCT | 585 | GGG | TGCCTGTGATCACTGTGCCTGTTTTAGAGCTAGAAATAGCAAGTTAAAATAAGGCTAGTCCGTTATCAACTTGAAAAAGTGGCACCGAGTCGGTGCTTTT | 848 |

TABLE 9-continued

| Genomic Coordinates of the Target Start Site in Genome Reference Consortium Human Build 37 (GRCh37): Chromosome 20) | Strand | Target sequence | SEQ ID NO | PAM | sgRNA sequence [PLEASE ADVISE, NO "Us"] | SEQ ID NO |
|---|---|---|---|---|---|---|
| 43030296 | -1 | ATGCCTGTGATCACTGTGCC | 586 | TGG | ATGCCTGTGATCACTGTGCCGTTTAGAGCTAGAAATAGCAAGTTAAAATAAGGCTAGTCCGTTATCAACTTGAAAAAGTGGCACCGAGTCGGTGCTTTT | 849 |
| 43030304 | 1 | TGCCCAGGCACAGTGATCAC | 587 | AGG | TGCCCAGGCACAGTGATCACGTTTTAGAGCTAGAAATAGCAAGTTAAAATAAGGCTAGTCCGTTATCAACTTGAAAAAGTGGCACCGAGTCGGTGCTTTT | 850 |
| 43030312 | 1 | CACAGTGATCACAGGCATTC | 588 | TGG | CACAGTGATCACAGGCATTCGTTTTAGAGCTAGAAATAGCAAGTTAAAATAAGGCTAGTCCGTTATCAACTTGAAAAAGTGGCACCGAGTCGGTGCTTTT | 851 |
| 43030313 | 1 | ACAGTGATCACAGGCATTCT | 589 | GGG | ACAGTGATCACAGGCATTCTGTTTTAGAGCTAGAAATAGCAAGTTAAAATAAGGCTAGTCCGTTATCAACTTGAAAAAGTGGCACCGAGTCGGTGCTTTT | 852 |
| 43030319 | 1 | ATCACAGGCATTCTGGGTGA | 590 | AGG | ATCACAGGCATTCTGGGTGAGTTTTAGAGCTAGAAATAGCAAGTTAAAATAAGGCTAGTCCGTTATCAACTTGAAAAAGTGGCACCGAGTCGGTGCTTTT | 853 |
| 43030320 | 1 | TCACAGGCATTCTGGGTGAA | 591 | GGG | TCACAGGCATTCTGGGTGAAGTTTTAGAGCTAGAAATAGCAAGTTAAAATAAGGCTAGTCCGTTATCAACTTGAAAAAGTGGCACCGAGTCGGTGCTTTT | 854 |
| 43030323 | 1 | CAGGCATTCTGGGTGAAGGG | 592 | AGG | CAGGCATTCTGGGTGAAGGGGTTTTAGAGCTAGAAATAGCAAGTTAAAATAAGGCTAGTCCGTTATCAACTTGAAAAAGTGGCACCGAGTCGGTGCTTTT | 855 |
| 43030332 | 1 | TGGGTGAAGGGAGGCCTGCA | 593 | AGG | TGGGTGAAGGGAGGCCTGCAGTTTTAGAGCTAGAAATAGCAAGTTAAAATAAGGCTAGTCCGTTATCAACTTGAAAAAGTGGCACCGAGTCGGTGCTTTT | 856 |
| 43030333 | 1 | GGGTGAAGGGAGGCCTGCAA | 594 | GGG | GGGTGAAGGGAGGCCTGCAAGTTTTAGAGCTAGAAATAGCAAGTTAAAATAAGGCTAGTCCGTTATCAACTTGAAAAAGTGGCACCGAGTCGGTGCTTTT | 857 |
| 43030335 | -1 | TGCTGGAAATTGGCCCTTGC | 595 | AGG | TGCTGGAAATTGGCCCTTGCGTTTTAGAGCTAGAAATAGCAAGTTAAAATAAGGCTAGTCCGTTATCAACTTGAAAAAGTGGCACCGAGTCGGTGCTTTT | 858 |

Table 10 below provides exemplary target nucleotide sequences of an HNF4α expression control genomic region and the corresponding zinc finger DNA binding domain amino acid sequences and amino acid structures of disrupting agent fusion proteins comprising a zing finger polypeptide and an effector suitable for use in the present invention.

The forward strand of the HNF4α expression control region targeted by the exemplary target nucleotide sequence in Table 10 comprises the nucleotide sequence of:

(SEQ ID NO: 859)
CTCCGGGAGGGGGTGGGGGTGAGGGAAACAGGAGAATGTGATGGGAAAATC

CGAGATGGAGCCAGCCTGGGCCAGAAACACTGGGAGCTGTGGGAGACGGAG

AGGGGCAGGGTGGGATCACAGGGAGCAGGAGCGGGGAATTGGAGGTGAATC

TGGCCCTCCCAAACTTCCAGTCCATTCTGCTCCCAGGGGAACCGGGAAACT

GCGGGGGAACTGGAAGGGAGCTCCCAGAACAAGGATCCAGAAGATTGGCAT

CTGGGGCCTGGGATTTAGGTTTCTAAATCGTGGGCCATGGGCAGCCTTAT

CTCTGCAAAAGCATTGAGGGTAGAAGTCAATGATTTGGGAAGTTATTGAAT

TAGGGGATCTCGGAGGTAGGCTGTCAGTGCCTGATAGTATCAGTTAGAATG

CCTGACTTGGGGTGACAATGGCTTGGAGGGGTGGGTGAGTCAAGGGTCAAA

TGAGTGCCCGTGAGTCATGATGCCTGCCTTGTACAATTGATAACTGAACAT

CGGTGAGTTAGGGCCCCAGCAGTTGTAATTAGCACCCCGGGTGTCAGCCAG

AAACCAACAAACAGCCAAATCCCTGCAGCCCCGCCCAGCCTATCCACCGGC

GGGGGACCGATTAACCATTAACCCCCACCCCTCCCCGGCAGAGCCTCCACC

CCTTCACAGAGGCTAGGCCAAGACTCCCAGCAGATCTTCCCAGAGGACGGT

TTGAAAGGAAGGCAGAGAGGGCACTGGGAGGAGGCAGTGGGAGGGCGGAGG

GCGGGGGCCTTCGGGGTGGGCGCCCAGGGTAGGGCAGGTGGCCGCGGCGTG

GAGGCAGGGAGAATGCGACTCTCCAAAACCCTCGTCGACATGGACATGGCC

GACTACAGTGCTGCACTGGACCCAGCCTACACCACCCTGGAATTTGAGAAT

GTGCAGGTGTTGACGATGGGCAATGGTAGGTGGGGGCAGATGTGCCCAGGT

GTGCCAGTGGGGGCAGGTGTGCCTGGGTCCAGGAGCAGATCTTTGGCACTC

AACTTTGGGGTGGGAGGAGAATGATACAAAATGGTAGGTTGGTCCTACAGG

CCAGCACAGGTGTTGCCAAGTGAAGCCCATGTGCCCAGGCACAGTGATCAC

AGGCATTCTGGGTGAAGGGAGGCCTGCAAGGGCCAATTTCCAGCAAAAGTT

GAT

The reverse strand of the HNF4α expression control region targeted by the exemplary target nucleotide sequence in Table 10 comprises the sequence of:

(SEQ ID NO: 860)
ATCGACTTTTGCTGGAAATTGGCCCTTGCAGGCCTCCCTTCACCCAGAATG

CCTGTGATCACTGTGCCTGGGCACATGGGCTTCACTTGGCAACACCTGTGC

TGGCCTGTAGGACCAACCTACCATTTTGTATCATTCTCCTCCCACCCCAAA

GTTGAGTGCCAAAGATCTGCTCCTGGACCCAGGCACACCTGCCCCCACTGG

CACACCTGGGCACATCTGCCCCCACCTACCATTGCCCATCGTCAACACCTG

CACATTCTCAAATTCCAGGGTGGTGTAGGCTGGGTCCAGTGCAGCACTGTA

GTCGGCCATGTCCATGTCGACGAGGGTTTTGGAGAGTCGCATTCTCCCTGC

CTCCACGCCGCGGCCACCTGCCCTACCCTGGGCGCCCACCCCGAAGGCCCC

CGCCCTCCGCCCTCCCACTGCCTCCTCCCAGTGCCCTCTCTGCCTTCCTTT

CAAACCGTCCTCTGGGAAGATCTGCTGGGAGTCTTGGCCTAGCCTCTGTGA

AGGGGTGGAGGCTCTGCCGGGGAGGGGTGGGGGTTAATGGTTAATCGGTCC

CCCGCCGGTGGATAGGCTGGGCGGGGCTGCAGGGATTTGGCTGTTTGTTGG

TTTCTGGCTGACACCCGGGGTGCTAATTACAACTGCTGGGGCCCTAACTCA

CCGATGTTCAGTTATCAATTGTACAAGGCAGGCATCATGACTCACGGGCAC

TCATTTGACCCTTGACTCACCCACCCCTCCAAGCCATTGTCACCCCAAGTC

AGGCATTCTAACTGATACTATCAGGCACTGACAGCCTACCTCCGAGATCCC

CTAATTCAATAACTTCCCAAATCATTGACTTCTACCCTCAATGCTTTTGCA

GAGATAAGGCTGCCCCATGGCCCACGATTTAGAAACCTAAATCCCAGGCCC

CAGATGCCAATCTTCTGGATCCTTGTTCTGGGAGCTCCCTTCCAGTTCCCC

CGCAGTTTCCCGGTTCCCCTGGGAGCAGAATGGACTGGAAGTTTGGGAGGG

CCAGATTCACCTCCAATTCCCCGCTCCTGCTCCCTGTGATCCCACCCTGCC

CCTCTCCGTCTCCCACAGCTCCCAGTGTTTCTGGCCCAGGCTGGCTCCATC

TCGGATTTTCCCATCACATTCTCCTGTTTCCCTCACCCCCACCCCCTCCCG

GAG

In some embodiments, the linker has the amino acid sequence of THPRAPIPKPFQ (SEQ ID NO: 311). In other embodiments, the linker has the amino acid sequence of TPNPHRRTDPSHKPFQ (SEQ ID NO: 312).

TABLE 10

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| agatggagc cagcctggg cca | 861 | AGA TGG AGC CAG CCT ggg CCA | LEPGEKPYKCPECGKSFSTSHSL TEHQRTHTGEKPYKCPECGKSFS RSDKLVRHQRTHTGEKPYKCPEC GKSFSTKNSLTEHQRTHTGEKPY KCPECGKSFSRADNLTEHQRTHT GEKPYKCPECGKSFSERSHLREH QRTHTGEKPYKCPECGKSFSRSD HLITHQRTHTGEKPYKCPECGKS FSQLAHLRAHQRTHTGEKPTGKK TS | 1410 | $X_1X_2X_3X_4X_5X_6X_7X_8X_9CX_{10}X_{11}CX_{12}X_{13}X_{14}X_{15}X_{16}TSHSLTEHX_{17}X_{18}X_{19}$ $HX_{20}X_{21}X_{22}X_{23}X_{24}X_8X_9CX_{10}X_{11}CX_{12}X_{13}X_{14}X_{15}X_{16}RSDKLVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}TKNSLTEHX_{17}$ $X_{18}X_{19}HX_{20}X_{21}X_{22}X_{23}X_{24}X_8X_9CX_{10}X_{11}CX_{12}X_{13}X_{14}X_{15}X_{16}RADNLTEH$ $X_{17}X_{18}X_{19}HX_{20}X_{21}X_{22}X_{23}X_{24}X_8X_9CX_{10}X_{11}CX_{12}X_{13}X_{14}X_{15}X_{16}ERSHLR$ $EHX_{17}X_{18}X_{19}HX_{20}X_{21}X_{22}X_{23}X_{24}X_8X_9CX_{10}X_{11}CX_{12}X_{13}X_{14}X_{15}X_{16}RSDH$ $LTTHX_{17}X_{18}X_{19}HX_{20}X_{21}X_{22}X_{23}X_{24}X_8X_9CX_{10}X_{11}CX_{12}X_{13}X_{14}X_{15}X_{16}QL$ $AHLRAHX_{17}X_{18}X_{19}HX_{20}X_{21}X_{22}X_{23}X_{24}X_{25}X_{26}X_{27}X_{28}X_{29}X_{30}$ | 1959 |
| cagcctggg ccagaaaca ctg | 862 | CAG CCT ggg CCA GAA ACA CTG | LEPGEKPYKCPECGKSFSRNDAL TEHQRTHTGEKPYKCPECGKSFS SPADLTRHQRTHTGEKPYKCPEC GKSFSQSSNLVRHQRTHTGEKPY KCPECGKSFSTSHSLTEHQRTHT GEKPYKCPECGKSFSRSDKLVRH QRTHTGEKPYKCPECGKSFSTKN SLTEHQRTHTGEKPYKCPECGKS FSRADNLTEHQRTHTGEKPTGKK TS | 1411 | $X_1X_2X_3X_4X_5X_6X_7X_8X_9CX_{10}X_{11}CX_{12}X_{13}X_{14}X_{15}X_{16}RNDALTEHX_{17}X_{18}X_{19}$ $HX_{20}X_{21}X_{22}X_{23}X_{24}X_8X_9CX_{10}X_{11}CX_{12}X_{13}X_{14}X_{15}X_{16}SPADLTRHX_{17}X_{18}$ $X_{19}HX_{20}X_{21}X_{22}X_{23}X_{24}X_8X_9CX_{10}X_{11}CX_{12}X_{13}X_{14}X_{15}X_{16}QSSNLVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}TSHSLTEH$ $X_{17}X_{18}X_{19}HX_{20}X_{21}X_{22}X_{23}X_{24}X_8X_9CX_{10}X_{11}CX_{12}X_{13}X_{14}X_{15}X_{16}RSDKLV$ $RHX_{17}X_{18}X_{19}HX_{20}X_{21}X_{22}X_{23}X_{24}X_8X_9CX_{10}X_{11}CX_{12}X_{13}X_{14}X_{15}X_{16}TKNS$ $LTEHX_{17}X_{18}X_{19}HX_{20}X_{21}X_{22}X_{23}X_{24}X_8X_9CX_{10}X_{11}CX_{12}X_{13}X_{14}X_{15}X_{16}RA$ $DNLTEHX_{17}X_{18}X_{19}HX_{20}X_{21}X_{22}X_{23}X_{24}X_{25}X_{26}X_{27}X_{28}X_{29}X_{30}$ | 1960 |
| agccagcct gggccagaa aca | 863 | AGC CAG CCT ggg CCA GAA ACA | LEPGEKPYKCPECGKSFSSPADL TRHQRTHTGEKPYKCPECGKSFS QSSNLVRHQRTHTGEKPYKCPEC GKSFSTSHSLTEHQRTHTGEKPY KCPECGKSFSRSDKLVRHQRTHT GEKPYKCPECGKSFSTKNSLTEH QRTHTGEKPYKCPECGKSFSRAD NLTEHQRTHTGEKPYKCPECGKS FSERSHLREHQRTHTGEKPTGKK TS | 1412 | $X_1X_2X_3X_4X_5X_6X_7X_8X_9CX_{10}X_{11}CX_{12}X_{13}X_{14}X_{15}X_{16}SPADLTRHX_{17}X_{18}X_{19}$ $HX_{20}X_{21}X_{22}X_{23}X_{24}X_8X_9CX_{10}X_{11}CX_{12}X_{13}X_{14}X_{15}X_{16}QSSNLVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}TSHSLTEHX_{17}$ $X_{18}X_{19}HX_{20}X_{21}X_{22}X_{23}X_{24}X_8X_9CX_{10}X_{11}CX_{12}X_{13}X_{14}X_{15}X_{16}RSDKLVRH$ $X_{17}X_{18}X_{19}HX_{20}X_{21}X_{22}X_{23}X_{24}X_8X_9CX_{10}X_{11}CX_{12}X_{13}X_{14}X_{15}X_{16}TKNSLT$ $EHX_{17}X_{18}X_{19}HX_{20}X_{21}X_{22}X_{23}X_{24}X_8X_9CX_{10}X_{11}CX_{12}X_{13}X_{14}X_{15}X_{16}RADN$ $LTEHX_{17}X_{18}X_{19}HX_{20}X_{21}X_{22}X_{23}X_{24}X_8X_9CX_{10}X_{11}CX_{12}XEX_{14}X_{15}X_{16}ER$ $SHLREHX_{17}X_{18}X_{19}HX_{20}X_{21}X_{22}X_{23}X_{24}X_{25}X_{26}X_{27}X_{28}X_{29}X_{30}$ | 1961 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| tggagccag cctgggcca gaa | 864 | TGG AGC CAG CCT ggg CCA GAA | LEPGEKPYKCPECGKSFSQSSNL VRHQRTHTGEKPYKCPECGKSFS TSHSLTEHQRTHTGEKPYKCPEC GKSFSRSDKLVRHQRTHTGEKPY KCPECGKSFSTKNSLTEHQRTHT GEKPYKCPECGKSFSRADNLTEH QRTHTGEKPYKCPECGKSFSERS HLREHQRTHTGEKPYKCPECGKS FSRSDHLTTHQRTHTGEKPTGKK TS | 1413 | $X_1X_2X_3X_4X_5X_6X_7X_8X_9CX_{10}X_{11}CX_{12}X_{13}X_{14}X_{15}X_{16}QSSNLVRHX_{17}X_{18}X_{19}$ $HX_{20}X_{21}X_{22}X_{23}X_{24}X_8X_9CX_{10}X_{11}CX_{12}X_{13}X_{14}X_{15}X_{16}TSHSLTEHX_{17}X_{18}$ $X_{19}HX_{20}X_{21}X_{22}X_{23}X_{24}X_8X_9CX_{10}X_{11}CX_{12}X_{13}X_{14}X_{15}X_{16}RSDKLVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}TKNSLTEH$ $X_{17}X_{18}X_{19}HX_{20}X_{21}X_{22}X_{23}X_{24}X_8X_9CX_{10}X_{11}CX_{12}X_{13}X_{14}X_{15}X_{16}RADNLT$ $EHX_{17}X_{18}X_{19}HX_{20}X_{21}X_{22}X_{23}X_{24}X_8X_9CX_{10}X_{11}CX_{12}X_{13}X_{14}X_{15}X_{16}ERSH$ $LREHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DHLTTHX_{17}X_{18}X_{19}HX_{20}X_{21}X_{22}X_{23}X_{24}X_{25}X_{26}X_{27}X_{28}X_{29}X_{30}$ | 1962 |
| ccgagatgg agccagcct ggg | 865 | CCG AGA TGG AGC CAG CCT GGG | LEPGEKPYKCPECGKSFSRSDKL VRHQRTHTGEKPYKCPECGKSFS TKNSLTEHQRTHTGEKPYKCPEC GKSFSRADNLTEHQRTHTGEKPY KCPECGKSFSERSHLREHQRTHT GEKPYKCPECGKSFSRSDHLTTH QRTHTGEKPYKCPECGKSFSQLA HLRAHQRTHTGEKPYKCPECGKS FSRNDTLTEHQRTHTGEKPTGKK TS | 1414 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}$ $HX_{20}X_{21}X_{22}X_{23}X_{24}X_8X_9CX_{10}X_{11}CX_{12}X_{13}X_{14}X_{15}X_{16}TKNSLTEHX_{17}X_{18}$ $X_{19}HX_{20}X_{21}X_{22}X_{23}X_{24}X_8X_9CX_{10}X_{11}CX_{12}X_{13}X_{14}X_{15}X_{16}RADNLTEHX_{17}$ $X_{18}X_{19}HX_{20}X_{21}X_{22}X_{23}X_{24}X_8X_9CX_{10}X_{11}CX_{12}X_{13}X_{14}X_{15}X_{16}ERSHLREH$ $X_{17}X_{18}X_{19}HX_{20}X_{21}X_{22}X_{23}X_{24}X_8X_9CX_{10}X_{11}CX_{12}X_{13}X_{14}X_{15}X_{16}RSDHLT$ $THX_{17}X_{18}X_{19}HX_{20}X_{21}X_{22}X_{23}X_{24}X_8X_9CX_{10}X_{11}CX_{12}X_{13}X_{14}X_{15}X_{16}QLAH$ $LRAHX_{17}X_{18}X_{19}HX_{20}X_{21}X_{22}X_{23}X_{24}X_8X_9CX_{10}X_{11}CX_{12}X_{13}X_{14}X_{15}X_{16}RN$ $DTLTEHX_{17}X_{18}X_{19}HX_{20}X_{21}X_{22}X_{23}X_{24}X_{25}X_{26}X_{27}X_{28}X_{29}X_{30}$ | 1963 |
| aatccgaga tggagccag cct | 866 | AGA TGG AAT CCG AGC CAG CCT | LEPGEKPYKCPECGKSFSTKNSL TEHQRTHTGEKPYKCPECGKSFS RADNLTEHQRTHTGEKPYKCPEC GKSFSERSHLREHQRTHTGEKPY KCPECGKSFSRSDHLTTHQRTHT GEKPYKCPECGKSFSQLAHLRAH QRTHTGEKPYKCPECGKSFSRND TLTEHQRTHTGEKPYKCPECGKS FSTTGNLTVHQRTHTGEKPTGKK TS | 1415 | $X_1X_2X_3X_4X_5X_6X_7X_8X_9CX_{10}X_{11}CX_{12}X_{13}X_{14}X_{15}X_{16}TKNSLTEHX_{17}X_{18}X_{19}$ $HX_{20}X_{21}X_{22}X_{23}X_{24}X_8X_9CX_{10}X_{11}CX_{12}X_{13}X_{14}X_{15}X_{16}RADNLTEHX_{17}X_{18}$ $X_{19}HX_{20}X_{21}X_{22}X_{23}X_{24}X_8X_9CX_{10}X_{11}CX_{12}X_{13}X_{14}X_{15}X_{16}ERSHLREHX_{17}$ $X_{18}X_{19}HX_{20}X_{21}X_{22}X_{23}X_{24}X_8X_9CX_{10}X_{11}CX_{12}X_{13}X_{14}X_{15}X_{16}RSDHLTTH$ $X_{17}X_{18}X_{19}HX_{20}X_{21}X_{22}X_{23}X_{24}X_8X_9CX_{10}X_{11}CX_{12}X_{13}X_{14}X_{15}X_{16}QLAHLR$ $AHX_{17}X_{18}X_{19}HX_{20}X_{21}X_{22}X_{23}X_{24}X_8X_9CX_{10}X_{11}CX_{12}X_{13}X_{14}X_{15}X_{16}RNDT$ $LTEHX_{17}X_{18}X_{19}HX_{20}X_{21}X_{22}X_{23}X_{24}X_8X_9CX_{10}X_{11}CX_{12}X_{13}X_{14}X_{15}X_{16}TT$ $GNLTVHX_{17}X_{18}X_{19}HX_{20}X_{21}X_{22}X_{23}X_{24}X_{25}X_{26}X_{27}X_{28}X_{29}X_{30}$ | 1964 |
| aggagaatg tgatgggaa aat | 867 | AGG AGA ATG TGA TGG GAA AAT | LEPGEKPYKCPECGKSFSTTGNL TVHQRTHTGEKPYKCPECGKSFS QSSNLVRHQRTHTGEKPYKCPEC GKSFSRSDHLTTHQRTHTGEKPY KCPECGKSFSQAGHLASHQRTHT GEKPYKCPECGKSFSRRDELNVH QRTHTGEKPYKCPECGKSFSQLA HLRAHQRTHTGEKPYKCPECGKS FSRSDHLTNHQRTHTGEKPTGKK TS | 1416 | $X_1X_2X_3X_4X_5X_6X_7X_8X_9CX_{10}X_{11}CX_{12}X_{13}X_{14}X_{15}X_{16}TTGNLTVHX_{17}X_{18}X_{19}$ $HX_{20}X_{21}X_{22}X_{23}X_{24}X_8X_9CX_{10}X_{11}CX_{12}X_{13}X_{14}X_{15}X_{16}QSSNLVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}RSDHLTTHX_{17}$ $X_{18}X_{19}HX_{20}X_{21}X_{22}X_{23}X_{24}X_8X_9CX_{10}X_{11}CX_{12}X_{13}X_{14}X_{15}X_{16}QAGHLASH$ $X_{17}X_{18}X_{19}HX_{20}X_{21}X_{22}X_{23}X_{24}X_8X_9CX_{10}X_{11}CX_{12}X_{13}X_{14}X_{15}X_{16}RRDELN$ $VHX_{17}X_{18}X_{19}HX_{20}X_{21}X_{22}X_{23}X_{24}X_8X_9CX_{10}X_{11}CX_{12}X_{13}X_{14}X_{15}X_{16}QLAH$ $LRAHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DHLTNHX_{17}X_{18}X_{19}HX_{20}X_{21}X_{22}X_{23}X_{24}X_{25}X_{26}X_{27}X_{28}X_{29}X_{30}$ | 1965 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| aacaggaga atgtgatgg gaa | 868 | AAC AGG AGA ATG TGA TGG GAA | LEPGEKPYKCPECGKSFSQSSNL VRHQRTHTGEKPYKCPECGKSFS RSDHLTTHQRTHTGEKPYKCPEC GKSFSQAGHLASHQRTHTGEKPY KCPECGKSFSRRDELNVHQRTHT GEKPYKCPECGKSFSQLAHLRAH QRTHTGEKPYKCPECGKSFSRSD HLTNHQRTHTGEKPYKCPECGKS FSDSGNLRVHQRTHTGEKPTGKK TS | 1417 | $X_1X_2X_3X_4X_5X_6X_7X_8X_9CX_{10}X_{11}CX_{12}X_{13}X_{14}X_{15}X_{16}QSSNLVRHX_{17}X_{18}X_{19}$ $HX_{20}X_{21}X_{22}X_{23}X_{24}X_8X_9CX_{10}X_{11}CX_{12}X_{13}X_{14}X_{15}X_{16}RDSDHLTTHX_{17}X_{18}$ $X_{19}HX_{20}X_{21}X_{22}X_{23}X_{24}X_8X_9CX_{10}X_{11}CX_{12}X_{13}X_{14}HX_{15}X_{16}QAGHLASHX_{17}$ $X_{18}X_{19}HX_{20}X_{21}X_{22}X_{23}X_{24}X_8X_9CX_{10}X_{11}CX_{12}X_{13}X_{14}X_{15}X_{16}RRDELNVH$ $X_{17}X_{18}X_{19}HX_{20}X_{21}X_{22}X_{23}X_{24}X_8X_9CX_{10}X_{11}CX_{12}X_{13}X_{14}X_{15}X_{16}QLAHLR$ $AHX_{17}X_{18}X_{19}HX_{20}X_{21}X_{22}X_{23}X_{24}X_8X_9CX_{10}X_{11}CX_{12}X_{13}X_{14}X_{15}X_{16}RSDH$ $LTNHX_{17}X_{18}X_{19}HX_{20}X_{21}X_{22}X_{23}X_{24}X_8X_9CX_{10}X_{11}CX_{12}X_{13}X_{14}X_{15}X_{16}DS$ $GNLRVHX_{17}X_{18}X_{19}HX_{20}X_{21}X_{22}X_{23}X_{24}X_{25}X_{26}X_{27}X_{28}X_{29}X_{30}$ | 1966 |
| tgatgggaa aatccgaga tgg | 869 | TGA TGG GAA AAT CCG AGA TGG | LEPGEKPYKCPECGKSFSRSDHL TTHQRTHTGEKPYKCPECGKSFS QLAHLRAHQRTHTGEKPYKCPEC GKSFSRNDTLTEHQRTHTGEKPY KCPECGKSFSTTGNLTVHQRTHT GEKPYKCPECGKSFSQSSNLVRH QRTHTGEKPYKCPECGKSFSRSD HLTTHQRTHTGEKPYKCPECGKS FSQAGHLASHQRTHTGEKPTGKK TS | 1418 | $X_1X_2X_3X_4X_5X_6X_7X_8X_9CX_{10}X_{11}CX_{12}X_{13}X_{14}X_{15}X_{16}RSDHLTTHX_{17}X_{18}X_{19}$ $HX_{20}X_{21}X_{22}X_{23}X_{24}X_8X_9CX_{10}X_{11}CX_{12}X_{13}X_{14}X_{15}X_{16}QLAHLRAHX_{17}X_{18}$ $X_{19}HX_{20}X_{21}X_{22}X_{23}X_{24}X_8X_9CX_{10}X_{11}CX_{12}X_{13}X_{14}X_{15}X_{16}RNDTLTEHX_{17}$ $X_{18}X_{19}HX_{20}X_{21}X_{22}X_{23}X_{24}X_8X_9CX_{10}X_{11}CX_{12}X_{13}X_{14}X_{15}X_{16}TTGNLTVH$ $X_{17}X_{18}X_{19}HX_{20}X_{21}X_{22}X_{23}X_{24}X_8X_9CX_{10}X_{11}CX_{12}X_{13}X_{14}X_{15}X_{16}QSSNLV$ $RHX_{17}X_{18}X_{19}HX_{20}X_{21}X_{22}X_{23}X_{24}X_8X_9CX_{10}X_{11}CX_{12}X_{13}X_{14}X_{15}X_{16}RSDH$ $LTTHX_{17}X_{18}X_{19}HX_{20}X_{21}X_{22}X_{23}X_{24}X_8X_9CX_{10}X_{11}CX_{12}X_{13}X_{14}X_{15}X_{16}QA$ $GHLASHX_{17}X_{18}X_{19}HX_{20}X_{21}X_{22}X_{23}X_{24}X_{25}X_{26}X_{27}X_{28}X_{29}X_{30}$ | 1967 |
| gaaaatccg agatggagc cag | 870 | GAA AAT CCG AGA TGG AGC CAG | LEPGEKPYKCPECGKSFSRADNL TEHQRTHTGEKPYKCPECGKSFS ERSHLREHQRTHTGEKPYKCPEC GKSFSRSDHLTTHQRTHTGEKPY KCPECGKSFSQLAHLRAHQRTHT GEKPYKCPECGKSFSRNDTLTEH QRTHTGEKPYKCPECGKSFSTTG NLTVHQRTHTGEKPYKCPECGKS FSQSSNLVRHQRTHTGEKPTGKK TS | 1419 | $X_1X_2X_3X_4X_5X_6X_7X_8X_9CX_{10}X_{11}CX_{12}X_{13}X_{14}X_{15}X_{16}RADNLTEHX_{17}X_{18}X_{19}$ $HX_{20}X_{21}X_{22}X_{23}X_{24}X_8X_9CX_{10}X_{11}CX_{12}X_{13}X_{14}X_{15}X_{16}ERSHLREHX_{17}X_{18}$ $X_{19}HX_{20}X_{21}X_{22}X_{23}X_{24}X_8X_9CX_{10}X_{11}CX_{12}X_{13}X_{14}X_{15}X_{16}RSDHLTTHX_{17}$ $X_{18}X_{19}HX_{20}X_{21}X_{22}X_{23}X_{24}X_8X_9CX_{10}X_{11}CX_{12}X_{13}X_{14}X_{15}X_{16}QLAHLRAH$ $X_{17}X_{18}X_{19}HX_{20}X_{21}X_{22}X_{23}X_{24}X_8X_9CX_{10}X_{11}CX_{12}X_{13}X_{14}X_{15}X_{16}RNDTLT$ $EHX_{17}X_{18}X_{19}HX_{20}X_{21}X_{22}X_{23}X_{24}X_8X_9CX_{10}X_{11}CX_{12}X_{13}X_{14}X_{15}X_{16}TTGN$ $LTVHX_{17}X_{18}X_{19}HX_{20}X_{21}X_{22}X_{23}X_{24}X_8X_9CX_{10}X_{11}CX_{12}X_{13}X_{14}X_{15}X_{16}QS$ $SNLVRHX_{17}X_{18}X_{19}HX_{20}X_{21}X_{22}X_{23}X_{24}X_{25}X_{26}X_{27}X_{28}X_{29}X_{30}$ | 1968 |
| tgggaaaat ccgagatgg agc | 871 | TGG GAA AAT CCG AGA TGG AGC | LEPGEKPYKCPECGKSFSERSHL REHQRTHTGEKPYKCPECGKSFS RSDHLTTHQRTHTGEKPYKCPEC GKSFSQLAHLRAHQRTHTGEKPY KCPECGKSFSRNDTLTEHQRTHT GEKPYKCPECGKSFSTTGNLTVH QRTHTGEKPYKCPECGKSFSQSS NLVRHQRTHTGEKPYKCPECGKS FSRSDHLTTHQRTHTGEKPTGKK TS | 1420 | $X_1X_2X_3X_4X_5X_6X_7X_8X_9CX_{10}X_{11}CX_{12}X_{13}X_{14}X_{15}X_{16}ERSHLREHX_{17}X_{18}X_{19}$ $HX_{20}X_{21}X_{22}X_{23}X_{24}X_8X_9C10X_{11}CX_{12}X_{13}X_{14}X_{15}X_{16}RSDHLTTHX_{17}X_{18}$ $X_{19}HX_{20}X_{21}X_{22}X_{23}X_{24}X_8X_9CX_{10}X_{11}CX_{12}X_{13}X_{14}X_{15}X_{16}QLAHLRAHX_{17}$ $X_{18}X_{19}HX_{20}X_{21}X_{22}X_{23}X_{24}X_8X_9CX_{10}X_{11}CX_{12}X_{13}X_{14}X_{15}X_{16}RNDTLTEH$ $X_{17}X_{18}X_{19}HX_{20}X_{21}X_{22}X_{23}X_{24}X_8X_9CX_{10}X_{11}CX_{12}X_{13}X_{14}X_{15}X_{16}TTGNLT$ $VHX_{17}X_{18}X_{19}HX_{20}X_{21}X_{22}X_{23}X_{24}X_8X_9CX_{10}X_{11}CX_{12}X_{13}X_{14}X_{15}X_{16}QSSN$ $LVRHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DHLTTHX_{17}X_{18}X_{19}HX_{20}X_{21}X_{22}X_{23}X_{24}X_{25}X_{26}X_{27}X_{28}X_{29}X_{30}$ | 1969 |

TABLE 10-continued

| Column 1 Nucleotide Sequence of Target Site in HNF4α Expression Control Region | Column 2 Target sequence with space | Column 3 Target sequence | Column 4 Amino acid Sequence of Zinc Finger DNA Binding Domain Polypeptides Targeting the Target Site in Column 1 | Column 5 SEQ ID NO. (corresponds to sequences in Columns 1 and 3) | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| cctgggcca gaaacactg gga | CCT ggg GAA CCA ACA CTG GGA | 872 | LEPGEKPYKCPECGKSFSQRAHL ERHQRTHTGEKPYKCPECGKSFS RNDALTEHQRTHTGEKPYKCPEC GKSFSSPADLTRHQRTHTGEKPY KCPECGKSFSQSSNLVRHQRTHT GEKPYKCPECGKSFSTSHSLTEH QRTHTGEKPYKCPECGKSFSRSD KLVRHQRTHTGEKPYKCPECGKS FSTKNSLTEHQRTHTGEKPTGKK TS | 1421 | $X_1X_2X_3X_4X_5X_6X_7X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}QSSNLVRH X_{17}X_{18}X_{19}HX_{20}X_{21}X_{22}X_{23}X_{24}X_8X_9CX_{10}X_{11}CX_{12}X_{13}X_{14}X_{15}X_{16}TSHSLT EHX_{17}X_{18}X_{19}HX_{20}X_{21}X_{22}X_{23}X_{24}X_8X_9CX_{10}X_{11}CX_{12}X_{13}X_{14}X_{15}X_{16}RSDK LVRHX_{17}X_{18}X_{19}HX_{20}X_{21}X_{22}X_{23}X_{24}X_8X_9CX_{10}X_{11}CX_{12}X_{13}X_{14}X_{15}X_{16}TK NSLTEHX_{17}X_{18}X_{19}HX_{20}X_{21}X_{22}X_{23}X_{24}X_{25}X_{26}X_{27}X_{28}X_{29}X_{30}$ | 1970 |
| ccagaaaca ctgggagct gtg | CCA GAA ACA CTG GGA GCT GTG | 873 | LEPGEKPYKCPECGKSFSRSDEL VRHQRTHTGEKPYKCPECGKSFS TSGELVRHQRTHTGEKPYKCPEC GKSFSQRAHLERHQRTHTGEKPY KCPECGKSFSRNDALTEHQRTHT GEKPYKCPECGKSFSSPADLTRH QRTHTGEKPYKCPECGKSFSQSS NLVRHQRTHTGEKPYKCPECGKS FSTSHSLTEHQRTHTGEKPTGKK TS | 1422 | $X_1X_2X_3X_4X_5X_6X_7X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGELVRHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEH X_{17}X_{18}X_{19}HX_{20}X_{21}X_{22}X_{23}X_{24}X_8X_9CX_{10}X_{11}CX_{12}X_{13}X_{14}X_{15}X_{16}SPADLT RHX_{17}X_{18}X_{19}HX_{20}X_{21}X_{22}X_{23}X_{24}X_8X_9CX_{10}X_{11}CX_{12}X_{13}X_{14}X_{15}X_{16}QSSN LVRHX_{17}X_{18}X_{19}HX_{20}X_{21}X_{22}X_{23}X_{24}X_8X_9CX_{10}X_{11}CX_{12}X_{13}X_{14}X_{15}X_{16}TS HSLTEHX_{17}X_{18}X_{19}HX_{20}X_{21}X_{22}X_{23}X_{24}X_{25}X_{26}X_{27}X_{28}X_{29}X_{30}$ | 1971 |
| gggccagaa acactggga gct | ggg CCA GAA ACA CTG GGA GCT | 874 | LEPGEKPYKCPECGKSFSTSGEL VRHQRTHTGEKPYKCPECGKSFS QRAHLERHQRTHTGEKPYKCPEC GKSFSRNDALTEHQRTHTGEKPY KCPECGKSFSSPADLTRHQRTHT GEKPYKCPECGKSFSQSSNLVRH QRTHTGEKPYKCPECGKSFSTSH SLTEHQRTHTGEKPYKCPECGKS FSRSDKLVRHQRTHTGEKPTGKK TS | 1423 | $X_1X_2X_3X_4X_5X_6X_7X_8X_9CX_{10}X_{11}CX_{12}X_{13}X_{14}X_{15}X_{16}TSGELVRHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRH X_{17}X_{18}X_{19}HX_{20}X_{21}X_{22}X_{23}X_{24}X_8X_9CX_{10}X_{11}CX_{12}X_{13}X_{14}X_{15}X_{16}QSSNLV RHX_{17}X_{18}X_{19}HX_{20}X_{21}X_{22}X_{23}X_{24}X_8X_9CX_{10}X_{11}CX_{12}X_{13}X_{14}X_{15}X_{16}TSHS LTEHX_{17}X_{18}X_{19}HX_{20}X_{21}X_{22}X_{23}X_{24}X_8X_9CX_{10}X_{11}CX_{12}X_{13}X_{14}X_{15}X_{16}RS DKLVRHX_{17}X_{18}X_{19}HX_{20}X_{21}X_{22}X_{23}X_{24}X_{25}X_{26}X_{27}X_{28}X_{29}X_{30}$ | 1972 |
| gagggaaac aggagaatg tga | GAG GGA AAC AGG AGA ATG TGA | 875 | LEPGEKPYKCPECGKSFSQAGHL ASHQRTHTGEKPYKCPECGKSFS RRDELNVHQRTHTGEKPYKCPEC GKSFSQLAHLRAHQRTHTGEKPY KCPECGKSFSRSDHLTNHQRTHT GEKPYKCPECGKSFSDSGNLRVH QRTHTGEKPYKCPECGKSFSQRA HLERHQRTHTGEKPYKCPECGKS FSRSDNLVRHQRTHTGEKPTGKK TS | 1424 | $X_1X_2X_3X_4X_5X_6X_7X_8X_9CX_{10}X_{11}CX_{12}X_{13}X_{14}X_{15}X_{16}QAGHLASHX_{17}X_{18}X_{19}HX_{20}X_{21}X_{22}X_{23}X_{24}X_8X_9CX_{10}X_{11}CX_{12}X_{13}X_{14}X_{15}X_{16}RRDELNVHX_{17}X_{18}X_{19}HX_{20}X_{21}X_{22}X_{23}X_{24}X_8X_9CX_{10}X_{11}CX_{12}X_{13}X_{14}X_{15}X_{16}QLAHLRAHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNH X_{17}X_{18}X_{19}HX_{20}X_{21}X_{22}X_{23}X_{24}X_8X_9CX_{10}X_{11}CX_{12}X_{13}X_{14}X_{15}X_{16}DSGNLR VHX_{17}X_{18}X_{19}HX_{20}X_{21}X_{22}X_{23}X_{24}X_8X_9CX_{10}X_{11}CX_{12}X_{13}X_{14}X_{15}X_{16}QRAH LERHX_{17}X_{18}X_{19}HX_{20}X_{21}X_{22}X_{23}X_{24}X_8X_9CX_{10}X_{11}CX_{12}X_{13}X_{14}X_{15}X_{16}RS DNLVRHX_{17}X_{18}X_{19}HX_{20}X_{21}X_{22}X_{23}X_{24}X_{25}X_{26}X_{27}X_{28}X_{29}X_{30}$ | 1973 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| ggaaacagg agatgtga tgg | 876 | GGA AAC AGG AGA ATG TGA TGG | LEPGEKPYKCPECGKSFSRSDHL TTHQRTHTGEKPYKCPECGKSFS QAGHLASHQRTHTGEKPYKCPEC GKSFSRRDELNVHQRTHTGEKPY KCPECGKSFSQLAHLRAHQRTHT GEKPYKCPECGKSFSRSDHLTNH QRTHTGEKPYKCPECGKSFSDSG NLRVHQRTHTGEKPYKCPECGKS FSQRAHLERHQRTHTGEKPTGKK TS | 1425 | $X_1X_2X_3X_4X_5X_6X_7X_8X_9CX_{10}X_{11}CX_{12}X_{13}X_{14}X_{15}X_{16}RSDHLTTHX_{17}X_{18}X_{19}$ $HX_{20}X_{21}X_{22}X_{23}X_{24}X_{8}X_{9}CX_{10}X_{11}CX_{12}X_{13}X_{14}X_{15}X_{16}QAGHLASHX_{17}X_{18}$ $X_{19}HX_{20}X_{21}X_{22}X_{23}X_{24}X_{8}X_{9}CX_{10}X_{11}CX_{12}X_{13}X_{14}X_{15}X_{16}RRDELNVHX_{17}$ $X_{18}X_{19}HX_{20}X_{21}X_{22}X_{23}X_{24}X_{8}X_{9}CX_{10}X_{11}CX_{12}X_{13}X_{14}X_{15}X_{16}QLAHLRAH$ $X_{17}X_{18}X_{19}HX_{20}X_{21}X_{22}X_{23}X_{24}X_{8}X_{9}CX_{10}X_{11}CX_{12}X_{13}X_{14}X_{15}X_{16}RSDHLT$ $NHX_{17}X_{18}X_{19}HX_{20}X_{21}X_{22}X_{23}X_{24}X_{8}X_{9}CX_{10}X_{11}CX_{12}X_{13}X_{14}X_{15}X_{16}DSGN$ $LRVHX_{17}X_{18}X_{19}HX_{20}X_{21}X_{22}X_{23}X_{24}X_{8}X_{9}CX_{10}X_{11}CX_{12}X_{13}X_{14}X_{15}X_{16}QR$ $AHLERHX_{17}X_{18}X_{19}HX_{20}X_{21}X_{22}X_{23}X_{24}X_{25}X_{26}X_{27}X_{28}X_{29}X_{30}$ | 1974 |
| atgtgatgg gaaatccg aga | 877 | ATG TGA TGG GAA AAT CCG AGA | LEPGEKPYKCPECGKSFSQLAHL RAHQRTHTGEKPYKCPECGKSFS RNDTLTEHQRTHTGEKPYKCPEC GKSFSTTGNLTVHQRTHTGEKPY KCPECGKSFSQSSNLVRHQRTHT GEKPYKCPECGKSFSRSDHLTTH QRTHTGEKPYKCPECGKSFSQAG HLASHQRTHTGEKPYKCPECGKS FSRRDELNVHQRTHTGEKPTGKK TS | 1426 | $X_1X_2X_3X_4X_5X_6X_7X_8X_9CX_{10}X_{11}CX_{12}X_{13}X_{14}X_{15}X_{16}QLAHLRAHX_{17}X_{18}X_{19}$ $HX_{20}X_{21}X_{22}X_{23}X_{24}X_{8}X_{9}CX_{10}X_{11}CX_{12}X_{13}X_{14}X_{15}X_{16}RNDTLTEHX_{17}X_{18}$ $X_{19}HX_{20}X_{21}X_{22}X_{23}X_{24}X_{8}X_{9}CX_{10}X_{11}CX_{12}X_{13}X_{14}X_{15}X_{16}TTGNLTVHX_{17}$ $X_{18}X_{19}HX_{20}X_{21}X_{22}X_{23}X_{24}X_{8}X_{9}CX_{10}X_{11}CX_{12}X_{13}X_{14}X_{15}X_{16}QSSNLVRH$ $X_{17}X_{18}X_{19}HX_{20}X_{21}X_{22}X_{23}X_{24}X_{8}X_{9}CX_{10}X_{11}CX_{12}X_{13}X_{14}X_{15}X_{16}RSDHLY$ $THX_{17}X_{18}X_{19}HX_{20}X_{21}X_{22}X_{23}X_{24}X_{8}X_{9}CX_{10}X_{11}CX_{12}X_{13}X_{14}X_{15}X_{16}QAGH$ $LASHX_{17}X_{18}X_{19}HX_{20}X_{21}X_{22}X_{23}X_{24}X_{8}X_{9}CX_{10}X_{11}CX_{12}X_{13}X_{14}X_{15}X_{16}RR$ $DELNVHX_{17}X_{18}X_{19}HX_{20}X_{21}X_{22}X_{23}X_{24}X_{25}X_{26}X_{27}X_{28}X_{29}X_{30}$ | 1975 |
| agaatgtga tgggaaat ccg | 878 | AGA ATG TGA TGG GAA AT CCG | LEPGEKPYKCPECGKSFSRNDTL TEHQRTHTGEKPYKCPECGKSFS TTGNLTVHQRTHTGEKPYKCPEC GKSFSQSSNLVRHQRTHTGEKPY KCPECGKSFSRSDHLTTHQRTHT GEKPYKCPECGKSFSQAGHLASH QRTHTGEKPYKCPECGKSFSRRD ELNVHQRTHTGEKPYKCPECGKS FSQLAHLRAHQRTHTGEKPTGKK TS | 1427 | $X_1X_2X_3X_4X_5X_6X_7X_8X_9CX_{10}X_{11}CX_{12}X_{13}X_{14}X_{15}X_{16}RNDTLTEHX_{17}X_{18}X_{19}$ $HX_{20}X_{21}X_{22}X_{23}X_{24}X_{8}X_{9}CX_{10}X_{11}CX_{12}X_{13}X_{14}X_{15}X_{16}TTGNLTVHX_{17}X_{18}$ $X_{19}HX_{20}X_{21}X_{22}X_{23}X_{24}X_{8}X_{9}CX_{10}X_{11}CX_{12}X_{13}X_{14}X_{15}X_{16}QSSNLVRHX_{17}$ $X_{18}X_{19}HX_{20}X_{21}X_{22}X_{23}X_{24}X_{8}X_{9}CX_{10}X_{11}CX_{12}X_{13}X_{14}X_{15}X_{16}RSDHLTTH$ $X_{17}X_{18}X_{19}HX_{20}X_{21}X_{22}X_{23}X_{24}X_{8}X_{9}CX_{10}X_{11}CX_{12}X_{13}X_{14}X_{15}X_{16}QAGHLA$ $SHX_{17}X_{18}X_{19}HX_{20}X_{21}X_{22}X_{23}X_{24}X_{8}X_{9}CX_{10}X_{11}CX_{12}X_{13}X_{14}X_{15}X_{16}RRDE$ $LNVHX_{17}X_{18}X_{19}HX_{20}X_{21}X_{22}X_{23}X_{24}X_{8}X_{9}CX_{10}X_{11}CX_{12}X_{13}X_{14}X_{15}X_{16}QL$ $AHLRAHX_{17}X_{18}X_{19}HX_{20}X_{21}X_{22}X_{23}X_{24}X_{25}X_{26}X_{27}X_{28}X_{29}X_{30}$ | 1976 |
| gaaacactg ggagctgtg gga | 879 | GAA ACA CTG GGA GCT GTG GGA | LEPGEKPYKCPECGKSFSQRAHL ERHQRTHTGEKPYKCPECGKSFS RSDELVRHQRTHTGEKPYKCPEC GKSFSTSGELVRHQRTHTGEKPY KCPECGKSFSQRAHLERHQRTHT GEKPYKCPECGKSFSRNDALTEH QRTHTGEKPYKCPECGKSFSSPA DLTRHQRTHTGEKPYKCPECGKS FSQSSNLVRHQRTHTGEKPTGKK TS | 1428 | $X_1X_2X_3X_4X_5X_6X_7X_8X_9CX_{10}X_{11}CX_{12}X_{13}X_{14}X_{15}X_{16}QRAHLERHX_{17}X_{18}X_{19}$ $HX_{20}X_{21}X_{22}X_{23}X_{24}X_{8}X_{9}CX_{10}X_{11}CX_{12}X_{13}X_{14}X_{15}X_{16}RSDELVRHX_{17}X_{18}$ $X_{19}HX_{20}X_{21}X_{22}X_{23}X_{24}X_{8}X_{9}CX_{10}X_{11}CX_{12}X_{13}X_{14}X_{15}X_{16}TSGELVRHX_{17}$ $X_{18}X_{19}HX_{20}X_{21}X_{22}X_{23}X_{24}X_{8}X_{9}CX_{10}X_{11}CX_{12}X_{13}X_{14}X_{15}X_{16}QRAHLERH$ $X_{17}X_{18}X_{19}HX_{20}X_{21}X_{22}X_{23}X_{24}X_{8}X_{9}CX_{10}X_{11}CX_{12}X_{13}X_{14}X_{15}X_{16}RNDALT$ $EHX_{17}X_{18}X_{19}HX_{20}X_{21}X_{22}X_{23}X_{24}X_{8}X_{9}CX_{10}X_{11}CX_{12}X_{13}X_{14}X_{15}X_{16}SPAD$ $LTRHX_{17}X_{18}X_{19}HX_{20}X_{21}X_{22}X_{23}X_{24}X_{8}X_{9}CX_{10}X_{11}CX_{12}X_{13}X_{14}X_{15}X_{16}QS$ $SNLVRHX_{17}X_{18}X_{19}HX_{20}X_{21}X_{22}X_{23}X_{24}X_{25}X_{26}X_{27}X_{28}X_{29}X_{30}$ | 1977 |

TABLE 10-continued

| Column 1 Nucleotide Sequence of Target Site in HNF4α Expression Control Region | Column 2 Column 3 Target sequence with space | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gtgggagac gggagaggg cag | 880 | GTG GGA GAC GGG GAG GGG CAG | LEPGEKPYKCPECGKSFSRADNL TEHQRTHTGEKPYKCPECGKSFS RSDKLVRHQRTHTGEKPYKCPEC GKSFSRSDNLVRHQRTHTGEKPY KCPECGKSFSQRAHLERHQRTHT GEKPYKCPECGKSFSDPGNLVRH QRTHTGEKPYKCPECGKSFSQRA HLERHQRTHTGEKPYKCPECGKS FSRSDELVRHQRTHTGEKPTGKK TS | 1429 | $X_1X_2X_3X_4X_5X_6X_7X_8X_9CX_{10}X_{11}CX_{12}X_{13}X_{14}X_{15}X_{16}$RADNLTEHX$_{17}X_{18}X_{19}$ HX$_{20}X_{21}X_{22}X_{23}X_{24}X_8X_9CX_{10}X_{11}CX_{12}X_{13}X_{14}X_{15}X_{16}$RSDKLVRHX$_{17}X_{18}$ X$_{19}$HX$_{20}X_{21}X_{22}X_{23}X_{24}X_8X_9CX_{10}X_{11}CX_{12}X_{13}X_{14}X_{15}X_{16}$RSDNLVRHX$_{17}$ X$_{18}X_{19}$HX$_{20}X_{21}X_{22}X_{23}X_{24}X_8X_9CX_{10}X_{11}CX_{12}X_{13}X_{14}X_{15}X_{16}$QRAHLERH X$_{17}X_{18}X_{19}$HX$_{20}X_{21}X_{22}X_{23}X_{24}X_8X_9CX_{10}X_{11}CX_{12}X_{13}X_{14}X_{15}X_{16}$DPGNLV RHX$_{17}X_{18}X_{19}$HX$_{20}X_{21}X_{22}X_{23}X_{24}X_8X_9CX_{10}X_{11}CX_{12}X_{13}X_{14}X_{15}X_{16}$QRAH LERHX$_{17}X_{18}X_{19}$HX$_{20}X_{21}X_{22}X_{23}X_{24}X_8X_9CX_{10}X_{11}CX_{12}X_{13}X_{14}X_{15}X_{16}$RS DELVRHX$_{17}X_{18}X_{19}$HX$_{20}X_{21}X_{22}X_{23}X_{24}X_{25}X_{26}X_{27}X_{28}X_{29}X_{30}$ | 1978 |
| acactggga gctgtggga gac | 881 | ACA CTG GGA GCT GTG GGA GAC | LEPGEKPYKCPECGKSFSDPGNL VRHQRTHTGEKPYKCPECGKSFS QRAHLERHQRTHTGEKPYKCPEC GKSFSRSDELVRHQRTHTGEKPY KCPECGKSFSTSGELVRHQRTHT GEKPYKCPECGKSFSQRAHLERH QRTHTGEKPYKCPECGKSFSRND ALTEHQRTHTGEKPYKCPECGKS FSSPADLTRHQRTHTGEKPTGKK TS | 1430 | $X_1X_2X_3X_4X_5X_6X_7X_8X_9CX_{10}X_{11}CX_{12}X_{13}X_{14}X_{15}X_{16}$DPGNLVRHX$_{17}X_{18}X_{19}$ HX$_{20}X_{21}X_{22}X_{23}X_{24}X_8X_9CX_{10}X_{11}CX_{12}X_{13}X_{14}X_{15}X_{16}$QRAHLERHX$_{17}X_{18}$ X$_{19}$HX$_{20}X_{21}X_{22}X_{23}X_{24}X_8X_9CX_{10}X_{11}CX_{12}X_{13}X_{14}X_{15}X_{16}$RSDELVRHX$_{17}$ X$_{18}X_{19}$HX$_{20}X_{21}X_{22}X_{23}X_{24}X_8X_9CX_{10}X_{11}CX_{12}X_{13}X_{14}X_{15}X_{16}$TSGELVRH RHX$_{17}X_{18}X_{19}$HX$_{20}X_{21}X_{22}X_{23}X_{24}X_8X_9CX_{10}X_{11}CX_{12}X_{13}X_{14}X_{15}X_{16}$QRAHLE LTEHX$_{17}X_{18}X_{19}$HX$_{20}X_{21}X_{22}X_{23}X_{24}X_8X_9CX_{10}X_{11}CX_{12}X_{13}X_{14}X_{15}X_{16}$RNDA ADLTRHX$_{17}X_{18}X_{19}$HX$_{20}X_{21}X_{22}X_{23}X_{24}X_{25}X_{26}X_{27}X_{28}X_{29}X_{30}$ | 1979 |
| gctgtggga gacgggagag ggg | 882 | GCT GTG GGA GAC GGG GAG GGG | LEPGEKPYKCPECGKSFSRSDKL VRHQRTHTGEKPYKCPECGKSFS RSDNLVRHQRTHTGEKPYKCPEC GKSFSQRAHLERHQRTHTGEKPY KCPECGKSFSDPGNLVRHQRTHT GEKPYKCPECGKSFSQRAHLERH QRTHTGEKPYKCPECGKSFSRSD ELVRHQRTHTGEKPYKCPECGKS FSTSGELVRHQRTHTGEKPTGKK TS | 1431 | $X_1X_2X_3X_4X_5X_6X_7X_8X_9CX_{10}X_{11}CX_{12}X_{13}X_{14}X_{15}X_{16}$RSDKLVRHX$_{17}X_{18}X_{19}$ HX$_{20}X_{21}X_{22}X_{23}X_{24}X_8X_9CX_{10}X_{11}CX_{12}X_{13}X_{14}X_{15}X_{16}$RSDNLVRHX$_{17}X_{18}$ X$_{19}$HX$_{20}X_{21}X_{22}X_{23}X_{24}X_8X_9CX_{10}X_{11}CX_{12}X_{13}X_{14}X_{15}X_{16}$QRAHLERHX$_{17}$ X$_{18}X_{19}$HX$_{20}X_{21}X_{22}X_{23}X_{24}X_8X_9CX_{10}X_{11}CX_{12}X_{13}X_{14}X_{15}X_{16}$DPGNLVRH X$_{17}X_{18}X_{19}$HX$_{20}X_{21}X_{22}X_{23}X_{24}X_8X_9CX_{10}X_{11}CX_{12}X_{13}X_{14}X_{15}X_{16}$QRAHLE RHX$_{17}X_{18}X_{19}$HX$_{20}X_{21}X_{22}X_{23}X_{24}X_8X_9CX_{10}X_{11}CX_{12}X_{13}X_{14}X_{15}X_{16}$RSDE LVRHX$_{17}X_{18}X_{19}$HX$_{20}X_{21}X_{22}X_{23}X_{24}X_8X_9CX_{10}X_{11}CX_{12}X_{13}X_{14}X_{15}X_{16}$TS GELVRHX$_{17}X_{18}X_{19}$HX$_{20}X_{21}X_{22}X_{23}X_{24}X_{25}X_{26}X_{27}X_{28}X_{29}X_{30}$ | 1980 |
| ctgggagct gtgggagac gga | 883 | CTG GGA GCT GTG GGA GAC GGA | LEPGEKPYKCPECGKSFSQRAHL ERHQRTHTGEKPYKCPECGKSFS DPGNLVRHQRTHTGEKPYKCPEC GKSFSQRAHLERHQRTHTGEKPY KCPECGKSFSRSDELVRHQRTHT GEKPYKCPECGKSFSTSGELVRH QRTHTGEKPYKCPECGKSFSQRA HLERHQRTHTGEKPYKCPECGKS FSRNDALTEHQRTHTGEKPTGKK TS | 1432 | $X_1X_2X_3X_4X_5X_6X_7X_8X_9CX_{10}X_{11}CX_{12}X_{13}X_{14}X_{15}X_{16}$QRAHLERHX$_{17}X_{18}X_{19}$ HX$_{20}X_{21}X_{22}X_{23}X_{24}X_8X_9CX_{10}X_{11}CX_{12}X_{13}X_{14}X_{15}X_{16}$DPGNLVRHX$_{17}X_{18}$ X$_{19}$HX$_{20}X_{21}X_{22}X_{23}X_{24}X_8X_9CX_{10}X_{11}CX_{12}X_{13}X_{14}X_{15}X_{16}$QRAHLERHX$_{17}$ X$_{18}X_{19}$HX$_{20}X_{21}X_{22}X_{23}X_{24}X_8X_9CX_{10}X_{11}CX_{12}X_{13}X_{14}X_{15}X_{16}$RSDELVRH RHX$_{17}X_{18}X_{19}$HX$_{20}X_{21}X_{22}X_{23}X_{24}X_8X_9CX_{10}X_{11}CX_{12}X_{13}X_{14}X_{15}X_{16}$TSGELV LERHX$_{17}X_{18}X_{19}$HX$_{20}X_{21}X_{22}X_{23}X_{24}X_8X_9CX_{10}X_{11}CX_{12}X_{13}X_{14}X_{15}X_{16}$QRAH DALTEHX$_{17}X_{18}X_{19}$HX$_{20}X_{21}X_{22}X_{23}X_{24}X_{25}X_{26}X_{27}X_{28}X_{29}X_{30}$ | 1981 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| ggagctgtg gggaggga gag | 884 | GGA GCT GTG GAC GGA GAG | LEPGEKPYKCPECGKSFSRSDNL VRHQRTHTGEKPYKCPECGKSFS QRAHLERHQRTHTGEKPYKCPEC GKSFSDPGNLVRHQRTHTGEKPY KCPECGKSFSQRAHLERHQRTHT GEKPYKCPECGKSFSRSDELVRH QRTHTGEKPYKCPECGKSFSTSG ELVRHQRTHTGEKPYKCPECGKS FSQRAHLERHQRTHTGEKPTGKK TS | 1433 | $X_1X_2X_3X_4X_5X_6X_7X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}DPGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGELVRHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_{25}X_{26}X_{27}X_{28}X_{29}X_{30}$ | 1982 |
| gggggtgag ggaacagg aga | 885 | GGG GGT GAG AAC AGG AGA | LEPGEKPYKCPECGKSFSQLAHL RAHQRTHTGEKPYKCPECGKSFS RSDHLTNHQRTHTGEKPYKCPEC GKSFSDSGNLRVHQRTHTGEKPY KCPECGKSFSQRAHLERHQRTHT GEKPYKCPECGKSFSRSDNLVRH QRTHTGEKPYKCPECGKSFSTSG HLVRHQRTHTGEKPYKCPECGKS FSRSDKLVRHQRTHTGEKPTGKK TS | 1434 | $X_1X_2X_3X_4X_5X_6X_7X_8X_9CX_{10}X_{11}CX_{12}X_{13}X_{14}X_{15}X_{16}QLAHLRAHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}DSGNLRVHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_{25}X_{26}X_{27}X_{28}X_{29}X_{30}$ | 1983 |
| gacgagag gggcaggt ggg | 886 | GAC GGA GAG GGG CAG GGT | LEPGEKPYKCPECGKSFSRSDKL VRHQRTHTGEKPYKCPECGKSFS TSGHLVRHQRTHTGEKPYKCPEC GKSFSRADNLTEHQRTHTGEKPY KCPECGKSFSRSDKLVRHQRTHT GEKPYKCPECGKSFSRSDNLVRH QRTHTGEKPYKCPECGKSFSQRA HLERHQRTHTGEKPYKCPECGKS FSDPGNLVRHQRTHTGEKPTGKK TS | 1435 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}DPGNLVRHX_{17}X_{18}X_{19}HX_{20}X_{21}X_{22}X_{23}X_{24}X_{25}X_{26}X_{27}X_{28}X_{29}X_{30}$ | 1984 |
| ggtgaggga aacaggga atg | 887 | GGT GAG GGA AAC AGG AGA ATG | LEPGEKPYKCPECGKSFSRRDEL NVHQRTHTGEKPYKCPECGKSFS QLAHLRAHQRTHTGEKPYKCPEC GKSFSRSDHLTNHQRTHTGEKPY KCPECGKSFSDSGNLRVHQRTHT GEKPYKCPECGKSFSQRAHLERH QRTHTGEKPYKCPECGKSFSRSD NLVRHQRTHTGEKPYKCPECGKS FSTSGHLVRHQRTHTGEKPTGKK TS | 1436 | $X_1X_2X_3X_4X_5X_6X_7X_8X_9CX_{10}X_{11}CX_{12}X_{13}X_{14}X_{15}X_{16}RRDELNVHX_{17}X_{18}X_{19}HX_{20}X_{21}X_{22}X_{23}X_{24}X_8X_9CX_{10}X_{11}CX_{12}X_{13}X_{14}X_{15}X_{16}QLAHLRAHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}DSGNLRVHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_{25}X_{26}X_{27}X_{28}X_{29}X_{30}$ | 1985 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| ggagacgga gagggcag ggt | 888 | GGA GAC GGA GAG ggg CAG GGT | LEPGEKPYKCPECGKSFSTSGHL VRHQRTHTGEKPYKCPECGKSFS RADNLTEHQRTHTGEKPYKCPEC GKSFSRSDKLVRHQRTHTGEKPY KCPECGKSFSRSDNLVRHQRTHT GEKPYKCPECGKSFSQRAHLERH QRTHTGEKPYKCPECGKSFSDPG NLVRHQRTHTGEKPYKCPECGKS FSQRAHLERHQRTHTGEKPTGKK TS | 1437 | $X_1X_2X_3X_4X_5X_6X_7X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}DPGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_{25}X_{26}X_{27}X_{28}X_{29}X_{30}$ | 1986 |
| ggggtggg ggtgaggga aac | 889 | GGG GGT GGG GGT GAG GGA AAC | LEPGEKPYKCPECGKSFSDSGNL RVHQRTHTGEKPYKCPECGKSFS QRAHLERHQRTHTGEKPYKCPEC GKSFSRSDNLVRHQRTHTGEKPY KCPECGKSFSTSGHLVRHQRTHT GEKPYKCPECGKSFSRSDKLVRH QRTHTGEKPYKCPECGKSFSTSG HLVRHQRTHTGEKPYKCPECGKS FSRSDKLVRHQRTHTGEKPTGKK TS | 1438 | $X_1X_2X_3X_4X_5X_6X_7X_8X_9CX_{10}X_{11}CX_{12}X_{13}X_{14}X_{15}X_{16}DSGNLRVHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_{25}X_{26}X_{27}X_{28}X_{29}X_{30}$ | 1987 |
| ggtggggt gaggggaaac agg | 890 | GGT GGG GGT GAG GGA AAC AGG | LEPGEKPYKCPECGKSFSRSDHL TNHQRTHTGEKPYKCPECGKSFS DSGNLRVHQRTHTGEKPYKCPEC GKSFSQRAHLERHQRTHTGEKPY KCPECGKSFSRSDNLVRHQRTHT GEKPYKCPECGKSFSTSGHLVRH QRTHTGEKPYKCPECGKSFSRSD KLVRHQRTHTGEKPYKCPECGKS FSTSGHLVRHQRTHTGEKPTGKK TS | 1439 | $X_1X_2X_3X_4X_5X_6X_7X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}DSGNLRVHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_{25}X_{26}X_{27}X_{28}X_{29}X_{30}$ | 1988 |
| ggagggggt ggggtgag gga | 891 | GGA GGG GGT GGG GGT GAG GGA | LEPGEKPYKCPECGKSFSQRAHL ERHQRTHTGEKPYKCPECGKSFS RSDNLVRHQRTHTGEKPYKCPEC GKSFSTSGHLVRHQRTHTGEKPY KCPECGKSFSRSDKLVRHQRTHT GEKPYKCPECGKSFSTSGHLVRH QRTHTGEKPYKCPECGKSFSRSD KLVRHQRTHTGEKPYKCPECGKS FSQRAHLERHQRTHTGEKPTGKK TS | 1440 | $X_1X_2X_3X_4X_5X_6X_7X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_{25}X_{26}X_{27}X_{28}X_{29}X_{30}$ | 1989 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| ccggaggg ggtggggt gag | 892 | CCG GGA GGG GGT GAG | LEPGEKPYKCPECGKSFSRSDNL VRHQRTHTGEKPYKCPECGKSFS TSGHLVRHQRTHTGEKPYKCPEC GKSFSRSDKLVRHQRTHTGEKPY KCPECGKSFSTSGHLVRHQRTHT GEKPYKCPECGKSFSRSDKLVRH QRTHTGEKPYKCPECGKSFSQRA HLERHQRTHTGEKPYKCPECGKS FSRNDTLTEHQRTHTGEKPTGKK TS | 1441 | $X_1X_2X_3X_4X_5X_6X_7X_8X_9CX_{10}X_{11}CX_{12}X_{13}X_{14}X_{15}X_{16}RSDNLVRHX_{17}X_{18}X_{19}$ $HX_{20}X_{21}X_{22}X_{23}X_{24}X_8X_9CX_{10}X_{11}CX_{12}X_{13}X_{14}X_{15}X_{16}TSGHLVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}RSDKLVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}TSGHLVRH$ $X_{17}X_{18}X_{19}HX_{20}X_{21}X_{22}X_{23}X_{24}X_8X_9CX_{10}X_{11}CX_{12}X_{13}X_{14}X_{15}X_{16}RSDKLV$ $RHX_{17}X_{18}X_{19}HX_{20}X_{21}X_{22}X_{23}X_{24}X_8X_9CX_{10}X_{11}CX_{12}X_{13}X_{14}X_{15}X_{16}QRAH$ $LERHX_{17}X_{18}X_{19}HX_{20}X_{21}X_{22}X_{23}X_{24}X_8X_9CX_{10}X_{11}CX_{12}X_{13}X_{14}X_{15}X_{16}RN$ $DTLTEHX_{17}X_{18}X_{19}HX_{20}X_{21}X_{22}X_{23}X_{24}X_{25}X_{26}X_{27}X_{28}X_{29}X_{30}$ | 1990 |
| cggaaggg gtggggtg agg | 893 | CGG GAG GGG GTG AGG | LEPGEKPYKCPECGKSFSRSDHL TNHQRTHTGEKPYKCPECGKSFS RSDELVRHQRTHTGEKPYKCPEC GKSFSRSDKLVRHQRTHTGEKPY KCPECGKSFSRSDELVRHQRTHT GEKPYKCPECGKSFSRSDKLVRH QRTHTGEKPYKCPECGKSFSRSD NLVRHQRTHTGEKPYKCPECGKS FSRSDKLTEHQRTHTGEKPTGKK TS | 1442 | $X_1X_2X_3X_4X_5X_6X_7X_8X_9CX_{10}X_{11}CX_{12}X_{13}X_{14}X_{15}X_{16}RSDHLTNHX_{17}X_{18}X_{19}$ $HX_{20}X_{21}X_{22}X_{23}X_{24}X_8X_9CX_{10}X_{11}CX_{12}X_{13}X_{14}X_{15}X_{16}RSDELVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}RSDKLVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}RSDELVRH$ $X_{17}X_{18}X_{19}HX_{20}X_{21}X_{22}X_{23}X_{24}X_8X_9CX_{10}X_{11}CX_{12}X_{13}X_{14}X_{15}X_{16}RSDKLV$ $RHX_{17}X_{18}X_{19}HX_{20}X_{21}X_{22}X_{23}X_{24}X_8X_9CX_{10}X_{11}CX_{12}X_{13}X_{14}X_{15}X_{16}RSDN$ $LVRHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DKLTEHX_{17}X_{18}X_{19}HX_{20}X_{21}X_{22}X_{23}X_{24}X_{25}X_{26}X_{27}X_{28}X_{29}X_{30}$ | 1991 |
| gaggggtg gggtgcagg gtg agg aga | 894 | GAG GGG GTG gtg AGG GAA | LEPGEKPYKCPECGKSFSQSSNL VRHQRTHTGEKPYKCPECGKSFS RSDHLTNHQRTHTGEKPYKCPEC GKSFSRSDELVRHQRTHTGEKPY KCPECGKSFSRSDKLVRHQRTHT GEKPYKCPECGKSFSRSDELVRH QRTHTGEKPYKCPECGKSFSRSD KLVRHQRTHTGEKPYKCPECGKS FSRSDNLVRHQRTHTGEKPTGKK TS | 1443 | $X_1X_2X_3X_4X_5X_6X_7X_8X_9CX_{10}X_{11}CX_{12}X_{13}X_{14}X_{15}X_{16}QSSNLVRHX_{17}X_{18}X_{19}$ $HX_{20}X_{21}X_{22}X_{23}X_{24}X_8X_9CX_{10}X_{11}CX_{12}X_{13}X_{14}X_{15}X_{16}RSDHLTNHX_{17}X_{18}$ $X_{19}HX_{20}X_{21}X_{22}X_{23}X_{24}X_8X_9CX_{10}X_{11}CX_{12}X_{13}X_{14}X_{15}X_{16}RSDELVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}RSDKLVRH$ $X_{17}X_{18}X_{19}HX_{20}X_{21}X_{22}X_{23}X_{24}X_8X_9CX_{10}X_{11}CX_{12}X_{13}X_{14}X_{15}X_{16}RSDELV$ $RHX_{17}X_{18}X_{19}HX_{20}X_{21}X_{22}X_{23}X_{24}X_8X_9CX_{10}X_{11}CX_{12}X_{13}X_{14}X_{15}X_{16}RSDK$ $LVRHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DNLVRHX_{17}X_{18}X_{19}HX_{20}X_{21}X_{22}X_{23}X_{24}X_{25}X_{26}X_{27}X_{28}X_{29}X_{30}$ | 1992 |
| gggtgggg gtgaggaa aca | 895 | GGG GTG gtg AGG GAA ACA | LEPGEKPYKCPECGKSFSSPADL TRHQRTHTGEKPYKCPECGKSFS QSSNLVRHQRTHTGEKPYKCPEC GKSFSRSDHLTNHQRTHTGEKPY KCPECGKSFSRSDELVRHQRTHT GEKPYKCPECGKSFSRSDKLVRH QRTHTGEKPYKCPECGKSFSRSD ELVRHQRTHTGEKPYKCPECGKS FSRSDKLVRHQRTHTGEKPTGKK TS | 1444 | $X_1X_2X_3X_4X_5X_6X_7X_8X_9CX_{10}X_{11}CX_{12}X_{13}X_{14}X_{15}X_{16}SPADLTRHX_{17}X_{18}X_{19}$ $HX_{20}X_{21}X_{22}X_{23}X_{24}X_8X_9CX_{10}X_{11}CX_{12}X_{13}X_{14}X_{15}X_{16}QSSNLVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}RSDHLTNHX_{17}$ $X_{18}X_{19}HX_{20}X_{21}X_{22}X_{23}X_{24}X_8X_9CX_{10}X_{11}CX_{12}X_{13}X_{14}X_{15}X_{16}RSDELVRH$ $X_{17}X_{18}X_{19}HX_{20}X_{21}X_{22}X_{23}X_{24}X_8X_9CX_{10}X_{11}CX_{12}X_{13}X_{14}X_{15}X_{16}RSDKLV$ $RHX_{17}X_{18}X_{19}HX_{20}X_{21}X_{22}X_{23}X_{24}X_8X_9CX_{10}X_{11}CX_{12}X_{13}X_{14}X_{15}X_{16}RSDE$ $LVRHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DKLVRHX_{17}X_{18}X_{19}HX_{20}X_{21}X_{22}X_{23}X_{24}X_{25}X_{26}X_{27}X_{28}X_{29}X_{30}$ | 1993 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gtggggtg aggaaaca gga | 896 | GTG GGG gtg AGG GAA ACA GGA | LEPGEKPYKCPECGKSFSQRAHL ERHQRTHTGEKPYKCPECGKSFS SPADLTRHQRTHTGEKPYKCPEC GKSFSQSSNLVRHQRTHTGEKPY KCPECGKSFSRSDHLTNHQRTHT GEKPYKCPECGKSFSRSDELVRH QRTHTGEKPYKCPECGKSFSRSD KLVRHQRTHTGEKPYKCPECGKS FSRSDELVRHQRTHTGEKPTGKK TS | 1445 | $X_1X_2X_3X_4X_5X_6X_7X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}QSSNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNH X_{17}X_{18}X_{19}HX_{20}X_{21}X_{22}X_{23}X_{24}X_8X_9CX_{10}X_{11}CX_{12}X_{13}X_{14}X_{15}X_{16}RSDELV RHX_{17}X_{18}X_{19}HX_{20}X_{21}X_{22}X_{23}X_{24}X_8X_9CX_{10}X_{11}CX_{12}X_{13}X_{14}X_{15}X_{16}RSDK LVRHX_{17}X_{18}X_{19}HX_{20}X_{21}X_{22}X_{23}X_{24}X_8X_9CX_{10}X_{11}CX_{12}X_{13}X_{14}X_{15}X_{16}RS DELVRHX_{17}X_{18}X_{19}HX_{20}X_{21}X_{22}X_{23}X_{24}X_{25}X_{26}X_{27}X_{28}X_{29}X_{30}$ | 1994 |
| gggtgagg gaacagga gaa | 897 | GGG gtg AGG ACA GGA GAA | LEPGEKPYKCPECGKSFSQSSNL VRHQRTHTGEKPYKCPECGKSFS QRAHLERHQRTHTGEKPYKCPEC GKSFSSPADLTRHQRTHTGEKPY KCPECGKSFSQSSNLVRHQRTHT GEKPYKCPECGKSFSRSDHLTNH QRTHTGEKPYKCPECGKSFSRSD ELVRHQRTHTGEKPYKCPECGKS FSRSDKLVRHQRTHTGEKPTGKK TS | 1446 | $X_1X_2X_3X_4X_5X_6X_7X_8X_9CX_{10}X_{11}CX_{12}X_{13}X_{14}X_{15}X_{16}QSSNLVRHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}QSSNLVRH X_{17}X_{18}X_{19}HX_{20}X_{21}X_{22}X_{23}X_{24}X_8X_9CX_{10}X_{11}CX_{12}X_{13}X_{14}X_{15}X_{16}RSDHLT NHX_{17}X_{18}X_{19}HX_{20}X_{21}X_{22}X_{23}X_{24}X_8X_9CX_{10}X_{11}CX_{12}X_{13}X_{14}X_{15}X_{16}RSDE LVRHX_{17}X_{18}X_{19}HX_{20}X_{21}X_{22}X_{23}X_{24}X_8X_9CX_{10}X_{11}CX_{12}X_{13}X_{14}X_{15}X_{16}RS DKLVRHX_{17}X_{18}X_{19}HX_{20}X_{21}X_{22}X_{23}X_{24}X_{25}X_{26}X_{27}X_{28}X_{29}X_{30}$ | 1995 |
| gggtgaggg aacaggag aat | 898 | GGG TGA ggg CAG gag AAT | LEPGEKPYKCPECGKSFSTTGNL TVHQRTHTGEKPYKCPECGKSFS RSDNLVRHQRTHTGEKPYKCPEC GKSFSRADNLTEHHQRTHTGEKPY KCPECGKSFSQRANLRAHQRTHT GEKPYKCPECGKSFSRSDKLVRH QRTHTGEKPYKCPECGKSFSQAG HLASHQRTHTGEKPYKCPECGKS FSRSDKLVRHQRTHTGEKPTGKK TS | 1447 | $X_1X_2X_3X_4X_5X_6X_7X_8X_9CX_{10}X_{11}CX_{12}X_{13}X_{14}X_{15}X_{16}TTGNLTVHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}QRANLRAH X_{17}X_{18}X_{19}HX_{20}X_{21}X_{22}X_{23}X_{24}X_8X_9CX_{10}X_{11}CX_{12}X_{13}X_{14}X_{15}X_{16}RSDKLV RHX_{17}X_{18}X_{19}HX_{20}X_{21}X_{22}X_{23}X_{24}X_8X_9CX_{10}X_{11}CX_{12}X_{13}X_{14}X_{15}X_{16}QAGH LASHX_{17}X_{18}X_{19}HX_{20}X_{21}X_{22}X_{23}X_{24}X_8X_9CX_{10}X_{11}CX_{12}X_{13}X_{14}X_{15}X_{16}RS DKLVRHX_{17}X_{18}X_{19}HX_{20}X_{21}X_{22}X_{23}X_{24}X_{25}X_{26}X_{27}X_{28}X_{29}X_{30}$ | 1996 |
| gggtggggg tgagggaaa cag | 899 | GGG TGA ggg AAA CAG | LEPGEKPYKCPECGKSFSRADNL TEHQRTHTGEKPYKCPECGKSFS QRANLRAHQRTHTGEKPYKCPEC GKSFSRSDKLVRHQRTHTGEKPY KCPECGKSFSQAGHLASHQRTHT GEKPYKCPECGKSFSRSDKLVRH QRTHTGEKPYKCPECGKSFSRSDH HLTTHQRTHTGEKPYKCPECGKS FSRSDKLVRHQRTHTGEKPTGKK TS | 1448 | $X_1X_2X_3X_4X_5X_6X_7X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}QRANLRAHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QAGHLASH X_{17}X_{18}X_{19}HX_{20}X_{21}X_{22}X_{23}X_{24}X_8X_9CX_{10}X_{11}CX_{12}X_{13}X_{14}X_{15}X_{16}RSDKLV RHX_{17}X_{18}X_{19}HX_{20}X_{21}X_{22}X_{23}X_{24}X_8X_9CX_{10}X_{11}CX_{12}X_{13}X_{14}X_{15}X_{16}RSDH LTTHX_{17}X_{18}X_{19}HX_{20}X_{21}X_{22}X_{23}X_{24}X_8X_9CX_{10}X_{11}CX_{12}X_{13}X_{14}X_{15}X_{16}RS DKLVRHX_{17}X_{18}X_{19}HX_{20}X_{21}X_{22}X_{23}X_{24}X_{25}X_{26}X_{27}X_{28}X_{29}X_{30}$ | 1997 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| tgagggaaacaggagaatgtg | 900 | TGA ggg AAA CAG gag AAT GTG | LEPGEKPYKCPECGKSFSRSDEL VRHQRTHTGEKPYKCPECGKSFS TTGNLTVHQRTHTGEKPYKCPEC GKSFSRSDNLVRHQRTHTGEKPY KCPECGKSFSRADNLTEHQRTHT GEKPYKCPECGKSFSQRANLRAH QRTHTGEKPYKCPECGKSFSRSD KLVRHQRTHTGEKPYKCPECGKS FSQAGHLASHQRTHTGEKPTGKK TS | 1449 | $X_1X_2X_3X_4X_5X_6X_7X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}TTGNLTVHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}QRANLRAHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QAGHLASHX_{17}X_{18}X_{19}HX_{20}X_{21}X_{22}X_{23}X_{24}X_{25}X_{26}X_{27}X_{28}X_{29}X_{30}$ | 1998 |
| tggggggtgagggaaacaggag | 901 | TGG GGG TGA ggg AAA CAG gag | LEPGEKPYKCPECGKSFSRSDNL VRHQRTHTGEKPYKCPECGKSFS RADNLTEHQRTHTGEKPYKCPEC GKSFSQRANLRAHQRTHTGEKPY KCPECGKSFSRSDKLVRHQRTHT GEKPYKCPECGKSFSQAGHLASH QRTHTGEKPYKCPECGKSFSRSD KLVRHQRTHTGEKPYKCPECGKS FSRSDHLTTHQRTHTGEKPTGKK TS | 1450 | $X_1X_2X_3X_4X_5X_6X_7X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}QRANLRAHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QAGHLASHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_{25}X_{26}X_{27}X_{28}X_{29}X_{30}$ | 1999 |
| gggaggggggtgggggtgaggg | 902 | ggg AGG GGG TGG GGG TGA GGG | LEPGEKPYKCPECGKSFSRSDKL VRHQRTHTGEKPYKCPECGKSFS QAGHLASHQRTHTGEKPYKCPEC GKSFSRSDKLVRHQRTHTGEKPY KCPECGKSFSRSDHLTTHQRTHT GEKPYKCPECGKSFSRSDKLVRH QRTHTGEKPYKCPECGKSFSRSD HLTNHQRTHTGEKPYKCPECGKS FSRSDKLVRHQRTHTGEKPTGKK TS | 1451 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QAGHLASHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_{25}X_{26}X_{27}X_{28}X_{29}X_{30}$ | 2000 |
| agggggtgggggtgagggaaa | 903 | AGG GGG TGG GGG TGA ggg AAA | LEPGEKPYKCPECGKSFSQRANL RAHQRTHTGEKPYKCPECGKSFS RSDKLVRHQRTHTGEKPYKCPEC GKSFSQAGHLASHQRTHTGEKPY KCPECGKSFSRSDKLVRHQRTHT GEKPYKCPECGKSFSRSDHLTTH QRTHTGEKPYKCPECGKSFSRSD KLVRHQRTHTGEKPYKCPECGKS FSRSDHLTNHQRTHTGEKPTGKK TS | 1452 | $X_1X_2X_3X_4X_5X_6X_7X_8X_9CX_{10}X_{11}CX_{12}X_{13}X_{14}X_{15}X_{16}QRANLRAHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QAGHLASHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_{25}X_{26}X_{27}X_{28}X_{29}X_{30}$ | 2001 |

TABLE 10-continued

| Column 1 Nucleotide Sequence of Target Site in HNF4α Expression Control Region | Column 2 Target sequence with space | Column 3 SEQ ID NO. (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gggaaacag gagaatgtg atg | ggg AAA CAG gag AAT gtg ATG | 904 | LEPGEKPYKCPECGKSFSRRDEL NVHQRTHTGEKPYKCPECGKSFS RSDELVRHQRTHTGEKPYKCPEC GKSFSTTGNLTVHQRTHTGEKPY KCPECGKSFSRSDNLVRHQRTHT GEKPYKCPECGKSFSRADNLTEH QRTHTGEKPYKCPECGKSFSQRA NLRAHQRTHTGEKPYKCPECGKS FSRSDKLVRHQRTHTGEKPTGKK TS | 1453 | $X_1X_2X_3X_4X_5X_6X_7X_8X_9CX_{10}X_{11}CX_{12}X_{13}X_{14}X_{15}X_{16}RRDELNVHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}TTGNLTVHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRH X_{17}X_{18}X_{19}HX_{20}X_{21}X_{22}X_{23}X_{24}X_8X_9CX_{10}X_{11}CX_{12}X_{13}X_{14}X_{15}X_{16}RADNLT EHX_{17}X_{18}X_{19}HX_{20}X_{21}X_{22}X_{23}X_{24}X_8X_9CX_{10}X_{11}CX_{12}X_{13}X_{14}X_{15}X_{16}QRAN LRAHX_{17}X_{18}X_{19}HX_{20}X_{21}X_{22}X_{23}X_{24}X_8X_9CX_{10}X_{11}CX_{12}X_{13}X_{14}X_{15}X_{16}RS DKLVRHX_{17}X_{18}X_{19}HX_{20}X_{21}X_{22}X_{23}X_{24}X_{25}X_{26}X_{27}X_{28}X_{29}X_{30}$ | 2002 |
| aaacaggag aatgtgatg gga | AAA CAG gag AAT gtg ATG GGA | 905 | LEPGEKPYKCPECGKSFSQRAHL ERHQRTHTGEKPYKCPECGKSFS RRDELNVHQRTHTGEKPYKCPEC GKSFSRSDELVRHQRTHTGEKPY KCPECGKSFSTTGNLTVHQRTHT GEKPYKCPECGKSFSRSDNLVRH QRTHTGEKPYKCPECGKSFSRAD NLTEHQRTHTGEKPYKCPECGKS FSQRANLRAHQRTHTGEKPTGKK TS | 1454 | $X_1X_2X_3X_4X_5X_6X_7X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}RRDELNVHX_{17}X_{18}X_{11}X_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}TTGNLTVH X_{17}X_{18}X_{19}HX_{20}X_{21}X_{22}X_{23}X_{24}X_8X_9CX_{10}X_{11}CX_{12}X_{13}X_{14}X_{15}X_{16}RSDNLV RHX_{17}X_{18}X_{19}HX_{20}X_{21}X_{22}X_{23}X_{24}X_8X_9CX_{10}X_{11}CX_{12}X_{13}X_{14}X_{15}X_{16}RADN LTEHX_{17}X_{18}X_{19}HX_{20}X_{21}X_{22}X_{23}X_{24}X_8X_9CX_{10}X_{11}CX_{12}X_{13}X_{14}X_{15}X_{16}QR ANLRAHX_{17}X_{18}X_{19}HX_{20}X_{21}X_{22}X_{23}X_{24}X_{25}X_{26}X_{27}X_{28}X_{29}X_{30}$ | 2003 |
| caggagaat gtgatggga aaa | CAG gag AAT gtg ATG GGA AAA | 906 | LEPGEKPYKCPECGKSFSQRANL RAHQRTHTGEKPYKCPECGKSFS QRAHLERHQRTHTGEKPYKCPEC GKSFSRRDELNVHQRTHTGEKPY KCPECGKSFSRSDELVRHQRTHT GEKPYKCPECGKSFSTTGNLTVH QRTHTGEKPYKCPECGKSFSRSD NLVRHQRTHTGEKPYKCPECGKS FSRADNLTEHQRTHTGEKPTGKK TS | 1455 | $X_1X_2X_3X_4X_5X_6X_7X_8X_9CX_{10}X_{11}CX_{12}X_{13}X_{14}X_{15}X_{16}QRANLRAHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}RRDELNVHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRH X_{17}X_{18}X_{19}HX_{20}X_{21}X_{22}X_{23}X_{24}X_8X_9CX_{10}X_{11}CX_{12}X_{13}X_{14}X_{15}X_{16}TTGNLT VHX_{17}X_{18}X_{19}HX_{20}X_{21}X_{22}X_{23}X_{24}X_8X_9CX_{10}X_{11}CX_{12}X_{13}X_{14}X_{15}X_{16}RSDN LVRHX_{17}X_{18}X_{19}HX_{20}X_{21}X_{22}X_{23}X_{24}X_8X_9CX_{10}X_{11}CX_{12}X_{13}X_{14}X_{15}X_{16}RA DNLTEHX_{17}X_{18}X_{19}HX_{20}X_{21}X_{22}X_{23}X_{24}X_{25}X_{26}X_{27}X_{28}X_{29}X_{30}$ | 2004 |
| ggccagaaa cactggag ctg | GGC CAG AAA CAC TGG gag CTG | 907 | LEPGEKPYKCPECGKSFSRNDAL TEHQRTHTGEKPYKCPECGKSFS RSDNLVRHQRTHTGEKPYKCPEC GKSFSRSDHLTTHQRTHTGEKPY KCPECGKSFSSKKALTEHQRTHT GEKPYKCPECGKSFSQRANLRAH QRTHTGEKPYKCPECGKSFSRAD NLTEHQRTHTGEKPYKCPECGKS FSDPGHLVRHQRTHTGEKPTGKK TS | 1456 | $X_1X_2X_3X_4X_5X_6X_7X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEH X_{17}X_{18}X_{19}HX_{20}X_{21}X_{22}X_{23}X_{24}X_8X_9CX_{10}X_{11}CX_{12}X_{13}X_{14}X_{15}X_{16}QRANLR AHX_{17}X_{18}X_{19}HX_{20}X_{21}X_{22}X_{23}X_{24}X_8X_9CX_{10}X_{11}CX_{12}X_{13}X_{14}X_{15}X_{16}RADN LTEHX_{17}X_{18}X_{19}HX_{20}X_{21}X_{22}X_{23}X_{24}X_8X_9CX_{10}X_{11}CX_{12}X_{13}X_{14}X_{15}X_{16}DP GHLVRHX_{17}X_{18}X_{19}HX_{20}X_{21}X_{22}X_{23}X_{24}X_{25}X_{26}X_{27}X_{28}X_{29}X_{30}$ | 2005 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| ctgggccag aaacactgg gag | 908 | CTG GGC CAG AAA CAC TGG GAG | LEPGEKPYKCPECGKSFSRSDNL VRHQRTHTGEKPYKCPECGKSFS RSDHLTTHQRTHTGEKPYKCPEC GKSFSSKKALTEHQRTHTGEKPY KCPECGKSFSQRANLRAHQRTHT GEKPYKCPECGKSFSRADNLTEH QRTHTGEKPYKCPECGKSFSDPG HLVRHQRTHTGEKPYKCPECGKS FSRNDALTEHQRTHTGEKPTGKK TS | 1457 | $X_1X_2X_3X_4X_5X_6X_7X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}QRANLRAH X_{17}X_{18}X_{19}HX_{20}X_{21}X_{22}X_{23}X_{24}X_8X_9CX_{10}X_{11}CX_{12}X_{13}X_{14}X_{15}X_{16}RADNLT EHX_{17}X_{18}X_{19}HX_{20}X_{21}X_{22}X_{23}X_{24}X_8X_9CX_{10}X_{11}CX_{12}X_{13}X_{14}X_{15}X_{16}DPGH LVRHX_{17}X_{18}X_{19}HX_{20}X_{21}X_{22}X_{23}X_{24}X_8X_9CX_{10}X_{11}CX_{12}X_{13}X_{14}X_{15}X_{16}RN DALTEHX_{17}X_{18}X_{19}HX_{20}X_{21}X_{22}X_{23}X_{24}X_{25}X_{26}X_{27}X_{28}X_{29}X_{30}$ | 2006 |
| aaacactgg gagctgtgg gag | 909 | AAA CAC TGG gag CTG TGG GAG | LEPGEKPYKCPECGKSFSRSDNL VRHQRTHTGEKPYKCPECGKSFS RSDHLTTHQRTHTGEKPYKCPEC GKSFSRNDALTEHQRTHTGEKPY KCPECGKSFSRSDNLVRHQRTHT GEKPYKCPECGKSFSRSDHLTTH QRTHTGEKPYKCPECGKSFSSKK ALTEHQRTHTGEKPYKCPECGKS FSQRANLRAHQRTHTGEKPTGKK TS | 1458 | $X_1X_2X_3X_4X_5X_6X_7X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRH X_{17}X_{18}X_{19}HX_{20}X_{21}X_{22}X_{23}X_{24}X_8X_9CX_{10}X_{11}CX_{12}X_{13}X_{14}X_{15}X_{16}RSDNLT THX_{17}X_{18}X_{19}HX_{20}X_{21}X_{22}X_{23}X_{24}X_8X_9CX_{10}X_{11}CX_{12}X_{13}X_{14}X_{15}X_{16}SKKA LTEHX_{17}X_{18}X_{19}HX_{20}X_{21}X_{22}X_{23}X_{24}X_8X_9CX_{10}X_{11}CX_{12}X_{13}X_{14}X_{15}X_{16}QR ANLRAHX_{17}X_{18}X_{19}HX_{20}X_{21}X_{22}X_{23}X_{24}X_{25}X_{26}X_{27}X_{28}X_{29}X_{30}$ | 2007 |
| gccagcctg ggccagaaa cac | 910 | GCC AGC CTG GGC CAG AAA CAC | LEPGEKPYKCPECGKSFSSKKAL TEHQRTHTGEKPYKCPECGKSFS QRANLRAHQRTHTGEKPYKCPEC GKSFSRADNLTEHQRTHTGEKPY KCPECGKSFSDPGHLVRHQRTHT GEKPYKCPECGKSFSRNDALTEH QRTHTGEKPYKCPECGKSFSERS HLREHQRTHTGEKPYKCPECGKS FSDCRDLARHQRTHTGEKPTGKK TS | 1459 | $X_1X_2X_3X_4X_5X_6X_7X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}QRANLRAHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRH X_{17}X_{18}X_{19}HX_{20}X_{21}X_{22}X_{23}X_{24}X_8X_9CX_{10}X_{11}CX_{12}X_{13}X_{14}X_{15}X_{16}RNDALT EHX_{17}X_{18}X_{19}HX_{20}X_{21}X_{22}X_{23}X_{24}X_8X_9CX_{10}X_{11}CX_{12}X_{13}X_{14}X_{15}X_{16}ERSH LREHX_{17}X_{18}X_{19}HX_{20}X_{21}X_{22}X_{23}X_{24}X_8X_9CX_{10}X_{11}CX_{12}X_{13}X_{14}X_{15}X_{16}DC RDLARHX_{17}X_{18}X_{19}HX_{20}X_{21}X_{22}X_{23}X_{24}X_{25}X_{26}X_{27}X_{28}X_{29}X_{30}$ | 2008 |
| agcctgggc cagaaacac tgg | 911 | AGC CTG GGC CAG AAA CAC TGG | LEPGEKPYKCPECGKSFSRSDHL TTHQRTHTGEKPYKCPECGKSFS SKKALTEHQRTHTGEKPYKCPEC GKSFSQRANLRAHQRTHTGEKPY KCPECGKSFSRADNLTEHQRTHT GEKPYKCPECGKSFSDPGHLVRH QRTHTGEKPYKCPECGKSFSRND ALTEHQRTHTGEKPYKCPECGKS FSERSHLREHQRTHTGEKPTGKK TS | 1460 | $X_1X_2X_3X_4X_5X_6X_7X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}QRANLRAHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEH X_{17}X_{18}X_{19}HX_{20}X_{21}X_{22}X_{23}X_{24}X_8X_9CX_{10}X_{11}CX_{12}X_{13}X_{14}X_{15}X_{16}DPGHLV RHX_{17}X_{18}X_{19}HX_{20}X_{21}X_{22}X_{23}X_{24}X_8X_9CX_{10}X_{11}CX_{12}X_{13}X_{14}X_{15}X_{16}RNDA LTEHX_{17}X_{18}X_{19}HX_{20}X_{21}X_{22}X_{23}X_{24}X_8X_9CX_{10}X_{11}CX_{12}X_{13}X_{14}X_{15}X_{16}ER SHLREHX_{17}X_{18}X_{19}HX_{20}X_{21}X_{22}X_{23}X_{24}X_{25}X_{26}X_{27}X_{28}X_{29}X_{30}$ | 2009 |

TABLE 10-continued

| Column 1 Nucleotide Sequence of Target Site in HNF4α Expression Control Region | Column 2 Target sequence with space | Column 3 SEQ ID NO. (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| cagaaacac tgggagctg tgg | CAG AAA CAC TGG gag CTG TGG | 912 | LEPGEKPYKCPECGKSFSRSDHL TTHQRTHTGEKPYKCPECGKSFS RNDALTEHQRTHTGEKPYKCPEC GKSFSRSDNLVRHQRTHTGEKPY KCPECGKSFSRSDHLTTHQRTHT GEKPYKCPECGKSFSSKKALTEH QRTHTGEKPYKCPECGKSFSQRA NLRAHQRTHTGEKPYKCPECGKS FSRADNLTEHKPTGKK TS | 1461 | $X_1X_2X_3X_4X_5X_6X_7X_8X_9CX_{10}X_{11}CX_{12}X_{13}X_{14}X_{15}X_{16}RSDHLTTHX_{17}X_{18}X_{19}$ $HX_{20}X_{21}X_{22}X_{23}X_{24}X_8X_9CX_{10}X_{11}CX_{12}X_{13}X_{14}X_{15}X_{16}RNDALTEHX_{17}X_{18}$ $X_{19}HX_{20}X_{21}X_{22}X_{23}X_{24}X_8X_9CX_{10}X_{11}CX_{12}X_{13}X_{14}X_{15}X_{16}RSDNLVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}RSDHLTTH$ $X_{17}X_{18}X_{19}HX_{20}X_{21}X_{22}X_{23}X_{24}X_8X_9CX_{10}X_{11}CX_{12}X_{13}X_{14}X_{15}X_{16}SKKALT$ $EHX_{17}X_{18}X_{19}HX_{20}X_{21}X_{22}X_{23}X_{24}X_8X_9CX_{10}X_{11}CX_{12}X_{13}X_{14}X_{15}X_{16}QRAN$ $LRAHX_{17}X_{18}X_{19}HX_{20}X_{21}X_{22}X_{23}X_{24}X_8X_9CX_{10}X_{11}CX_{12}X_{13}X_{14}X_{15}X_{16}RA$ $DNLTEHX_{17}X_{18}X_{19}HX_{20}X_{21}X_{22}X_{23}X_{24}X_{25}X_{26}X_{27}X_{28}X_{29}X_{30}$ | 2010 |
| gatggagcc agcctgggc cag | GAT GGA GCC AGC CTG GGC CAG | 913 | LEPGEKPYKCPECGKSFSRADNL TEHQRTHTGEKPYKCPECGKSFS DPGHLVRHQRTHTGEKPYKCPEC GKSFSRNDALTEHQRTHTGEKPY KCPECGKSFSERSHLREHQRTHT GEKPYKCPECGKSFSDCRDLARH QRTHTGEKPYKCPECGKSFSQRA HLERHQRTHTGEKPYKCPECGKS FSTSGNLVRHQRTHTGEKPTGKK TS | 1462 | $X_1X_2X_3X_4X_5X_6X_7X_8X_9CX_{10}X_{11}CX_{12}X_{13}X_{14}X_{15}X_{16}RADNLTEHX_{17}X_{18}X_{19}$ $HX_{20}X_{21}X_{22}X_{23}X_{24}X_8X_9CX_{10}X_{11}CX_{12}X_{13}X_{14}X_{15}X_{16}DPGHLVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}RNDALTEHX_{17}$ $X_{18}X_{19}HX_{20}X_{21}X_{22}X_{23}X_{24}X_8X_9CX_{10}X_{11}CX_{12}X_{13}X_{14}X_{15}X_{16}ERSHLREH$ $X_{17}X_{18}X_{19}HX_{20}X_{21}X_{22}X_{23}X_{24}X_8X_9CX_{10}X_{11}CX_{12}X_{13}X_{14}X_{15}X_{16}DCRDLA$ $RHX_{17}X_{18}X_{19}HX_{20}X_{21}X_{22}X_{23}X_{24}X_8X_9CX_{10}X_{11}CX_{12}X_{13}X_{14}X_{15}X_{16}QRAH$ $LERHX_{17}X_{18}X_{19}HX_{20}X_{21}X_{22}X_{23}X_{24}X_8X_9CX_{10}X_{11}CX_{12}X_{13}X_{14}X_{15}X_{16}TS$ $GNLVRHX_{17}X_{18}X_{19}HX_{20}X_{21}X_{22}X_{23}X_{24}X_{25}X_{26}X_{27}X_{28}X_{29}X_{30}$ | 2011 |
| ggagccagc ctgggccag aaa | GGA GCC AGC CTG GGC CAG AAA | 914 | LEPGEKPYKCPECGKSFSQRANL RAHQRTHTGEKPYKCPECGKSFS RADNLTEHQRTHTGEKPYKCPEC GKSFSDPGHLVRHQRTHTGEKPY KCPECGKSFSRNDALTEHQRTHT GEKPYKCPECGKSFSERSHLREH QRTHTGEKPYKCPECGKSFSDCR DLARHQRTHTGEKPYKCPECGKS FSQRAHLERHQRTHTGEKPTGKK TS | 1463 | $X_1X_2X_3X_4X_5X_6X_7X_8X_9CX_{10}X_{11}CX_{12}X_{13}X_{14}X_{15}X_{16}QRANLRAHX_{17}X_{18}X_{19}$ $HX_{20}X_{21}X_{22}X_{23}X_{24}X_8X_9CX_{10}X_{11}CX_{12}X_{13}X_{14}X_{15}X_{16}RADNLTEHX_{17}X_{18}$ $X_{19}HX_{20}X_{21}X_{22}X_{23}X_{24}X_8X_9CX_{10}X_{11}CX_{12}X_{13}X_{14}X_{15}X_{16}DPGHLVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}RNDALTEH$ $X_{17}X_{18}X_{19}HX_{20}X_{21}X_{22}X_{23}X_{24}X_8X_9CX_{10}X_{11}CX_{12}X_{13}X_{14}X_{15}X_{16}ERSHLR$ $EHX_{17}X_{18}X_{19}HX_{20}X_{21}X_{22}X_{23}X_{24}X_8X_9CX_{10}X_{11}CX_{12}X_{13}X_{14}X_{15}X_{16}DCRD$ $LARHX_{17}X_{18}X_{19}HX_{20}X_{21}X_{22}X_{23}X_{24}X_8X_9CX_{10}X_{11}CX_{12}X_{13}X_{14}X_{15}X_{16}QR$ $AHLERHX_{17}X_{18}X_{19}HX_{20}X_{21}X_{22}X_{23}X_{24}X_{25}X_{26}X_{27}X_{28}X_{29}X_{30}$ | 2012 |
| tgggagctg tgggagacg gag | TGG gag CTG TGG gag ACG GAG | 915 | LEPGEKPYKCPECGKSFSRSDNL VRHQRTHTGEKPYKCPECGKSFS RTDTLRDHQRTHTGEKPYKCPEC GKSFSRSDNLVRHQRTHTGEKPY KCPECGKSFSRSDHLTTHQRTHT GEKPYKCPECGKSFSRNDALTEH QRTHTGEKPYKCPECGKSFSRSD NLVRHQRTHTGEKPYKCPECGKS FSRSDHLTTHQRTHTGEKPTGKK TS | 1464 | $X_1X_2X_3X_4X_5X_6X_7X_8X_9CX_{10}X_{11}CX_{12}X_{13}X_{14}X_{15}X_{16}RSDNLVRHX_{17}X_{18}X_{19}$ $HX_{20}X_{21}X_{22}X_{23}X_{24}X_8X_9CX_{10}X_{11}CX_{12}X_{13}X_{14}X_{15}X_{16}RTDTLRDHX_{17}X_{18}$ $X_{19}HX_{20}X_{21}X_{22}X_{23}X_{24}X_8X_9CX_{10}X_{11}CX_{12}X_{13}X_{14}X_{15}X_{16}RSDNLVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}RSDHLTTH$ $X_{17}X_{18}X_{19}HX_{20}X_{21}X_{22}X_{23}X_{24}X_8X_9CX_{10}X_{11}CX_{12}X_{13}X_{14}X_{15}X_{16}RNDALT$ $EHX_{17}X_{18}X_{19}HX_{20}X_{21}X_{22}X_{23}X_{24}X_8X_9CX_{10}X_{11}CX_{12}X_{13}X_{14}X_{15}X_{16}RSDN$ $LVRHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DHLTTHX_{17}X_{18}X_{19}HX_{20}X_{21}X_{22}X_{23}X_{24}X_{25}X_{26}X_{27}X_{28}X_{29}X_{30}$ | 2013 |

TABLE 10-continued

| Column 1 Nucleotide Sequence of Target Site in HNF4α Expression Control Region | Column 2 Target sequence with space | Column 3 Target sequence | Column 4 SEQ ID NO. (corresponds to sequences in Columns 1 and 3) | Column 5 Amino acid Sequence of Zinc Finger DNA Binding Domain Polypeptides Targeting the Target Site in Column 1 | Column 6 SEQ ID NO: | Column 7 Amino Acid Sequence Structure of Zinc Finger DNA Binding Domain Polypeptides Targeting the Target Site in Column 1 (see Table 1B above and description thereof) | SEQ ID NO: |
|---|---|---|---|---|---|---|---|
| gagctgtgg gagacggag agg | gag CTG TGG gag ACG gag AGG | | 916 | LEPGEKPYKCPECGKSFSRSDHL TNHQRTHTGEKPYKCPECGKSFS RSDNLVRHQRTHTGEKPYKCPEC GKSFSRTDTLRDHQRTHTGEKPY KCPECGKSFSRSDNLVRHQRTHT GEKPYKCPECGKSFSRSDNLVRH QRTHTGEKPYKCPECGKSFSRND ALTEHQRTHTGEKPYKCPECGKS FSRSDNLVRHQRTHTGEKPTGKK TS | 1465 | $X_1X_2X_3X_4X_5X_6X_7X_8X_9CX_{10}X_{11}CX_{12}X_{13}X_{14}X_{15}X_{16}RSDHLTNHX_{17}X_{18}X_{19}$ $HX_{20}X_{21}X_{22}X_{23}X_{24}X_8X_9CX_{10}X_{11}CX_{12}X_{13}X_{14}X_{15}X_{16}RSDNLVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}RTDTLRDHX_{17}$ $X_{18}X_{19}HX_{20}X_{21}X_{22}X_{23}X_{24}X_8X_9CX_{10}X_{11}CX_{12}X_{13}X_{14}X_{15}X_{16}RSDNLVRH$ $X_{17}X_{18}X_{19}HX_{20}X_{21}X_{22}X_{23}X_{24}X_8X_9CX_{10}X_{11}CX_{12}X_{13}X_{14}X_{15}X_{16}RSDHLT$ $THX_{17}X_{18}X_{19}HX_{20}X_{21}X_{22}X_{23}X_{24}X_8X_9CX_{10}X_{11}CX_{12}X_{13}X_{14}X_{15}X_{16}RNDA$ $LTEHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DNLVRHX_{17}X_{18}X_{19}HX_{20}X_{21}X_{22}X_{23}X_{24}X_{25}X_{26}X_{27}X_{28}X_{29}X_{30}$ | 2014 |
| ctgtgggag acggaggag ggc | CTG TGG gag ACG gag AGG GGC | | 917 | LEPGEKPYKCPECGKSFSDPGHL VRHQRTHTGEKPYKCPECGKSFS RSDHLTNHQRTHTGEKPYKCPEC GKSFSRSDNLVRHQRTHTGEKPY KCPECGKSFSRTDTLRDHQRTHT GEKPYKCPECGKSFSRSDNLVRH QRTHTGEKPYKCPECGKSFSRSD HLTTHQRTHTGEKPYKCPECGKS FSRNDALTEHQRTHTGEKPTGKK TS | 1466 | $X_1X_2X_3X_4X_5X_6X_7X_8X_9CX_{10}X_{11}CX_{12}X_{13}X_{14}X_{15}X_{16}DPGHLVRHX_{17}X_{18}X_{19}$ $HX_{20}X_{21}X_{22}X_{23}X_{24}X_8X_9CX_{10}X_{11}CX_{12}X_{13}X_{14}X_{15}X_{16}RSDNLVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}RSDNLVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}RTDTLRDH$ $X_{17}X_{18}X_{19}HX_{20}X_{21}X_{22}X_{23}X_{24}X_8X_9CX_{10}X_{11}CX_{12}X_{13}X_{14}X_{15}X_{16}RSDNLV$ $RHX_{17}X_{18}X_{19}HX_{20}X_{21}X_{22}X_{23}X_{24}X_8X_9CX_{10}X_{11}CX_{12}X_{13}X_{14}X_{15}X_{16}RSDH$ $LTTHX_{17}X_{18}X_{19}HX_{20}X_{21}X_{22}X_{23}X_{24}X_8X_9CX_{10}X_{11}CX_{12}X_{13}X_{14}X_{15}X_{16}RN$ $DALTEHX_{17}X_{18}X_{19}HX_{20}X_{21}X_{22}X_{23}X_{24}X_{25}X_{26}X_{27}X_{28}X_{29}X_{30}$ | 2015 |
| gagacggag agggcagg gtg | gag ACG gag AGG GGC AGG GTG | | 918 | LEPGEKPYKCPECGKSFSRSDEL VRHQRTHTGEKPYKCPECGKSFS RSDHLTNHQRTHTGEKPYKCPEC GKSFSDPGHLVRHQRTHTGEKPY KCPECGKSFSRSDHLTNHQRTHT GEKPYKCPECGKSFSRSDNLVRH QRTHTGEKPYKCPECGKSFSRTD TLRDHQRTHTGEKPYKCPECGKS FSRSDNLVRHQRTHTGEKPTGKK TS | 1467 | $X_1X_2X_3X_4X_5X_6X_7X_8X_9CX_{10}X_{11}CX_{12}X_{13}X_{14}X_{15}X_{16}RSDELVRHX_{17}X_{18}X_{19}$ $HX_{20}X_{21}X_{22}X_{23}X_{24}X_8X_9CX_{10}X_{11}CX_{12}X_{13}X_{14}X_{15}X_{16}RSDHLTNHX_{17}X_{18}$ $X_{19}HX_{20}X_{21}X_{22}X_{23}X_{24}X_8X_9CX_{10}X_{11}CX_{12}X_{13}X_{14}X_{15}X_{16}DPGHLVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}RSDHLTNH$ $X_{17}X_{18}X_{19}HX_{20}X_{21}X_{22}X_{23}X_{24}X_8X_9CX_{10}X_{11}CX_{12}X_{13}X_{14}X_{15}X_{16}RSDNLV$ $RHX_{17}X_{18}X_{19}HX_{20}X_{21}X_{22}X_{23}X_{24}X_8X_9CX_{10}X_{11}CX_{12}X_{13}X_{14}X_{15}X_{16}RTDT$ $LRDHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DNLVRHX_{17}X_{18}X_{19}HX_{20}X_{21}X_{22}X_{23}X_{24}X_{25}X_{26}X_{27}X_{28}X_{29}X_{30}$ | 2016 |
| tgggagacg gagagggc agg | TGG gag ACG gag AGG GGC AGG | | 919 | LEPGEKPYKCPECGKSFSRSDHL TNHQRTHTGEKPYKCPECGKSFS DPGHLVRHQRTHTGEKPYKCPEC GKSFSRSDHLTNHQRTHTGEKPY KCPECGKSFSRSDNLVRHQRTHT GEKPYKCPECGKSFSRTDTLRDH QRTHTGEKPYKCPECGKSFSRSD NLVRHQRTHTGEKPYKCPECGKS FSRSDHLTTHQRTHTGEKPTGKK TS | 1468 | $X_1X_2X_3X_4X_5X_6X_7X_8X_9CX_{10}X_{11}CX_{12}X_{13}X_{14}X_{15}X_{16}RSDHLTNHX_{17}X_{18}X_{19}$ $HX_{20}X_{21}X_{22}X_{23}X_{24}X_8X_9CX_{10}X_{11}CX_{12}X_{13}X_{14}X_{15}X_{16}DPGHLVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}RSDNLVRH$ $X_{18}X_{19}HX_{20}X_{21}X_{22}X_{23}X_{24}X_8X_9CX_{10}X_{11}CX_{12}X_{13}X_{14}X_{15}X_{16}RTDTLR$ $DHX_{17}X_{18}X_{19}HX_{20}X_{21}X_{22}X_{23}X_{24}X_8X_9CX_{10}X_{11}CX_{12}X_{13}X_{14}X_{15}X_{16}RSDN$ $LVRHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DHLTTHX_{17}X_{18}X_{19}HX_{20}X_{21}X_{22}X_{23}X_{24}X_{25}X_{26}X_{27}X_{28}X_{29}X_{30}$ | 2017 |

TABLE 10-continued

| Column 1 Nucleotide Sequence of Target Site in HNF4α Expression Control Region | Column 2 Target sequence with space | Column 3 SEQ ID NO. (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| cactgggag ctgtgggag acg | CAC TGG gag CTG TGG gag ACG | 920 | LEPGEKPYKCPECGKSFSRTDTL RDHQRTHTGEKPYKCPECGKSFS RSDNLVRHQRTHTGEKPYKCPEC GKSFSRSDHLTHQRTHTGEKPY KCPECGKSFSRNDALTEHQRTHT GEKPYKCPECGKSFSRSDNLVRH QRTHTGEKPYKCPECGKSFSRSD HLTTHQRTHTGEKPYKCPECGKS FSSKKALTEHQRTHTGEKPTGKK TS | 1469 | $X_1X_2X_3X_4X_5X_6X_7X_8X_9CX_{10}X_{11}CX_{12}X_{13}X_{14}X_{15}X_{16}RTDTLRDHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_{25}X_{26}X_{27}X_{28}X_{29}X_{30}$ | 2018 |
| acggagagg ggcagggtg gga | ACG gag AGG GGC AGG GTG GGA | 921 | LEPGEKPYKCPECGKSFSQRAHL ERHQRTHTGEKPYKCPECGKSFS RSDELVRHQRTHTGEKPYKCPEC GKSFSRSDHLTNHQRTHTGEKPY KCPECGKSFSDPGHLVRHQRTHT GEKPYKCPECGKSFSRSDHLTNH QRTHTGEKPYKCPECGKSFSRSD NLVRHQRTHTGEKPYKCPECGKS FSRTDTLRDHQRTHTGEKPTGKK TS | 1470 | $X_1X_2X_3X_4X_5X_6X_7X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RTDTLRDHX_{17}X_{18}X_{19}HX_{20}X_{21}X_{22}X_{23}X_{24}X_{25}X_{26}X_{27}X_{28}X_{29}X_{30}$ | 2019 |
| cgagatgga gccagcctg ggc | CGA GAT GGA GCC AGC CTG GGC | 922 | LEPGEKPYKCPECGKSFSDPGHL VRHQRTHTGEKPYKCPECGKSFS RNDALTEHQRTHTGEKPYKCPEC GKSFSERSHLREHQRTHTGEKPY KCPECGKSFSDCRDLARHQRTHT GEKPYKCPECGKSFSQRAHLERH QRTHTGEKPYKCPECGKSFSTSG NLVRHQRTHTGEKPYKCPECGKS FSQSGHLTEHQRTHTGEKPTGKK TS | 1471 | $X_1X_2X_3X_4X_5X_6X_7X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}ERSHLREHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARH X_{17}X_{18}X_{19}HX_{20}X_{21}X_{22}X_{23}X_{24}X_8X_9CX_{10}X_{11}CX_{12}X_{13}X_{14}X_{15}X_{16}QRAHLE RHX_{17}X_{18}X_{19}HX_{20}X_{21}X_{22}X_{23}X_{24}X_8X_9CX_{10}X_{11}CX_{12}X_{13}X_{14}X_{15}X_{16}TSGN LVRHX_{17}X_{18}X_{19}HX_{20}X_{21}X_{22}X_{23}X_{24}X_8X_9CX_{10}X_{11}CX_{12}X_{13}X_{14}X_{15}X_{16}QS GHLTEHX_{17}X_{18}X_{19}HX_{20}X_{21}X_{22}X_{23}X_{24}X_{25}X_{26}X_{27}X_{28}X_{29}X_{30}$ | 2020 |
| gcctgggcc agaaacact ggg | GCC TGG GCC AGA AAC ACT GGG | 923 | LEPGEKPYKCPECGKSFSRSDKL VRHQRTHTGEKPYKCPECGKSFS THLDLIRHQRTHTGEKPYKCPEC GKSFSDSGNLRVHQRTHTGEKPY KCPECGKSFSQLAHLRAHQRTHT GEKPYKCPECGKSFSDCRDLARH QRTHTGEKPYKCPECGKSFSRSD HLTTHQRTHTGEKPYKCPECGKS FSDCRDLARHQRTHTGEKPTGKK TS | 1472 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}THLDLIRHX_{17}X_{18}X_{19}HX_{20}X_{21}X_{22}X_{23}X_{24}X_8X_9CX_{10}X_{11}CX_{12}X_{13}X_{14}X_{15}X_{16}DSGNLRVHX_{17}X_{18}X_{19}HX_{20}X_{21}X_{22}X_{23}X_{24}X_8X_9CX_{10}X_{11}CX_{12}X_{13}X_{14}X_{15}X_{16}QLAHLRAH X_{17}X_{18}X_{19}HX_{20}X_{21}X_{22}X_{23}X_{24}X_8X_9CX_{10}X_{11}CX_{12}X_{13}X_{14}X_{15}X_{16}DCRDLA RHX_{17}X_{18}X_{19}HX_{20}X_{21}X_{22}X_{23}X_{24}X_8X_9CX_{10}X_{11}CX_{12}X_{13}X_{14}X_{15}X_{16}RSDH LTTHX_{17}X_{18}X_{19}HX_{20}X_{21}X_{22}X_{23}X_{24}X_8X_9CX_{10}X_{11}CX_{12}X_{13}X_{14}X_{15}X_{16}DC RDLARHX_{17}X_{18}X_{19}HX_{20}X_{21}X_{22}X_{23}X_{24}X_{25}X_{26}X_{27}X_{28}X_{29}X_{30}$ | 2021 |

TABLE 10-continued

| Column 1 Nucleotide Sequence of Target Site in HNF4α Expression Control Region | Column 2 Target sequence with space | Column 3 SEQ ID NO. (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| cagcctgg gccagaaac act | CCA GCC TGG GCC AGA AAC ACT | 924 | LEPGEKPYKCPECGKSFSTHLDL IRHQRTHTGEKPYKCPECGKSFS DSGNLRVHQRTHTGEKPYKCPEC GKSFSQLAHLRAHQRTHTGEKPY KCPECGKSFSDCRDLARHQRTHT GEKPYKCPECGKSFSRSDHLTTH QRTHTGEKPYKCPECGKSFSDCR DLARHQRTHTGEKPYKCPECGKS FSTSHSLTEHQRTHTGEKPTGKK TS | 1473 | $X_1X_2X_3X_4X_5X_6X_7X_8X_9CX_{10}X_{11}CX_{12}X_{13}X_{14}X_{15}X_{16}THLDLIRHX_{17}X_{18}X_{19}HX_{20}X_{21}X_{22}X_{23}X_{24}X_8X_9CX_{10}X_{11}CX_{12}X_{13}X_{14}X_{15}X_{16}DSGNLRVHX_{17}X_{18}X_{19}HX_{20}X_{21}X_{22}X_{23}X_{24}X_8X_9CX_{10}X_{11}CX_{12}X_{13}X_{14}X_{15}X_{16}QLAHLRAHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_{25}X_{26}X_{27}X_{28}X_{29}X_{30}$ | 2022 |
| tgggccaga aacactggg agc | TGG GCC AGA AAC ACT GGG AGC | 925 | LEPGEKPYKCPECGKSFSERSHL REHQRTHTGEKPYKCPECGKSFS RSDKLVRHQRTHTGEKPYKCPEC GKSFSTHLDLIRHQRTHTGEKPY KCPECGKSFSDSGNLRVHQRTHT GEKPYKCPECGKSFSQLAHLRAH QRTHTGEKPYKCPECGKSFSDCR DLARHQRTHTGEKPYKCPECGKS FSRSDHLTTHQRTHTGEKPTGKK TS | 1474 | $X_1X_2X_3X_4X_5X_6X_7X_8X_9CX_{10}X_{11}CX_{12}X_{13}X_{14}X_{15}X_{16}ERSHLREHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}THLDLIRHX_{17}X_{18}X_{19}HX_{20}X_{21}X_{22}X_{23}X_{24}X_8X_9CX_{10}X_{11}CX_{12}X_{13}X_{14}X_{15}X_{16}DSGNLRVHX_{17}X_{18}X_{19}HX_{20}X_{21}X_{22}X_{23}X_{24}X_8X_9CX_{10}X_{11}CX_{12}X_{13}X_{14}X_{15}X_{16}QLAHLRAHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_{25}X_{26}X_{27}X_{28}X_{29}X_{30}$ | 2023 |
| gagccagcc tgggccaga aac | gag CCA GCC TGG GCC AGA AAC | 926 | LEPGEKPYKCPECGKSFSDSGNL RVHQRTHTGEKPYKCPECGKSFS QLAHLRAHQRTHTGEKPYKCPEC GKSFSDCRDLARHQRTHTGEKPY KCPECGKSFSRSDHLTTHQRTHT GEKPYKCPECGKSFSDCRDLARH QRTHTGEKPYKCPECGKSFSTSH SLTEHQRTHTGEKPYKCPECGKS FSRSDNLVRHQRTHTGEKPTGKK TS | 1475 | $X_1X_2X_3X_4X_5X_6X_7X_8X_9CX_{10}X_{11}CX_{12}X_{13}X_{14}X_{15}X_{16}DSGNLRVHX_{17}X_{18}X_{19}HX_{20}X_{21}X_{22}X_{23}X_{24}X_8X_9CX_{10}X_{11}CX_{12}X_{13}X_{14}X_{15}X_{16}QLAHLRAHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_{25}X_{26}X_{27}X_{28}X_{29}X_{30}$ | 2024 |
| atggagcca gcctgggcc aga | ATG gag CCA GCC TGG GCC AGA | 927 | LEPGEKPYKCPECGKSFSQLAHL RAHQRTHTGEKPYKCPECGKSFS DCRDLARHQRTHTGEKPYKCPEC GKSFSRSDHLTTHQRTHTGEKPY KCPECGKSFSDCRDLARHQRTHT GEKPYKCPECGKSFSTSHSLTEH QRTHTGEKPYKCPECGKSFSRSD NLVRHQRTHTGEKPYKCPECGKS FSRRDELNVHQRTHTGEKPTGKK TS | 1476 | $X_1X_2X_3X_4X_5X_6X_7X_8X_9CX_{10}X_{11}CX_{12}X_{13}X_{14}X_{15}X_{16}QLAHLRAHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RRDELNVHX_{17}X_{18}X_{19}HX_{20}X_{21}X_{22}X_{23}X_{24}X_{25}X_{26}X_{27}X_{28}X_{29}X_{30}$ | 2025 |

TABLE 10-continued

| Column 1 Nucleotide Sequence of Target Site in HNF4α Expression Control Region | Column 3 Target sequence with space | Column 2 SEQ ID NO. (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gagatggag ccagcctgg gcc | gag ATG gag CCA GCC TGG GCC | 928 | LEPGEKPYKCPECGKSFSDCRDL ARHQRTHTGEKPYKCPECGKSFS RSDHLTTHQRTHTGEKPYKCPEC GKSFSDCRDLARHQRTHTGEKPY KCPECGKSFSTSHSLTEHQRTHT GEKPYKCPECGKSFSRSDNLVRH QRTHTGEKPYKCPECGKSFSRRD ELNVHQRTHTGEKPYKCPECGKS FSRSDNLVRHQRTHTGEKPTGKK TS | 1477 | $X_1X_2X_3X_4X_5X_6X_7X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEH X_{17}X_{18}X_{19}HX_{20}X_{21}X_{22}X_{23}X_{24}X_8X_9CX_{10}X_{11}CX_{12}X_{13}X_{14}X_{15}X_{16}RSDNLV RHX_{17}X_{18}X_{19}HX_{20}X_{21}X_{22}X_{23}X_{24}X_8X_9CX_{10}X_{11}CX_{12}X_{13}X_{14}X_{15}X_{16}RRDE LNVHX_{17}X_{18}X_{19}HX_{20}X_{21}X_{22}X_{23}X_{24}X_8X_9CX_{10}X_{11}CX_{12}X_{13}X_{14}X_{15}X_{16}RS DNLVRHX_{17}X_{18}X_{19}HX_{20}X_{21}X_{22}X_{23}X_{24}X_{25}X_{26}X_{27}X_{28}X_{29}X_{30}$ | 2026 |
| gggagacgg agagggca ggg | ggg AGA CGG AGA GGG GCA GGG | 929 | LEPGEKPYKCPECGKSFSRSDKL VRHQRTHTGEKPYKCPECGKSFS QSGDLRRHQRTHTGEKPYKCPEC GKSFSRSDKLVRHQRTHTGEKPY KCPECGKSFSQLAHLRAHQRTHT GEKPYKCPECGKSFSRSDKLTEH QRTHTGEKPYKCPECGKSFSQLA HLRAHQRTHTGEKPYKCPECGKS FSRSDKLVRHQRTHTGEKPTGKK TS | 1478 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QLAHLRAH X_{17}X_{18}X_{19}HX_{20}X_{21}X_{22}X_{23}X_{24}X_8X_9CX_{10}X_{11}CX_{12}X_{13}X_{14}X_{15}X_{16}RSDKLT EHX_{17}X_{18}X_{19}HX_{20}X_{21}X_{22}X_{23}X_{24}X_8X_9CX_{10}X_{11}CX_{12}X_{13}X_{14}X_{15}X_{16}QLAH LRAHX_{17}X_{18}X_{19}HX_{20}X_{21}X_{22}X_{23}X_{24}X_8X_9CX_{10}X_{11}CX_{12}X_{13}X_{14}X_{15}X_{16}RS DKLVRHX_{17}X_{18}X_{19}HX_{20}X_{21}X_{22}X_{23}X_{24}X_{25}X_{26}X_{27}X_{28}X_{29}X_{30}$ | 2027 |
| agacggaga gggcaggg tgg | AGA CGG AGA GGG GCA GGG TGG | 930 | LEPGEKPYKCPECGKSFSRSDHL TTHQRTHTGEKPYKCPECGKSFS RSDKLVRHQRTHTGEKPYKCPEC GKSF SQSGDLRRHQRTHTGEKPY KCPECGKSFSRSDKLVRHQRTHT GEKPYKCPECGKSFSQLAHLRAH QRTHTGEKPYKCPECGKSFSRSD KLTEHQRTHTGEKPYKCPECGKS FSQLAHLRAHQRTHTGEKPTGKK TS | 1479 | $X_1X_2X_3X_4X_5X_6X_7X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRH X_{17}X_{18}X_{19}HX_{20}X_{21}X_{22}X_{23}X_{24}X_8X_9CX_{10}X_{11}CX_{12}X_{13}X_{14}X_{15}X_{16}QLAHLR AHX_{17}X_{18}X_{19}HX_{20}X_{21}X_{22}X_{23}X_{24}X_8X_9CX_{10}X_{11}CX_{12}X_{13}X_{14}X_{15}X_{16}RSDK LTEHX_{17}X_{18}X_{19}HX_{20}X_{21}X_{22}X_{23}X_{24}X_8X_9CX_{10}X_{11}CX_{12}X_{13}X_{14}X_{15}X_{16}QL AHLRAHX_{17}X_{18}X_{19}HX_{20}X_{21}X_{22}X_{23}X_{24}X_{25}X_{26}X_{27}X_{28}X_{29}X_{30}$ | 2028 |
| cggagaggg gcagggtgg gat | CGG AGA GGG GCA GGG TGG GAT | 931 | LEPGEKPYKCPECGKSFSTSGNL VRHQRTHTGEKPYKCPECGKSFS RSDHLTTHQRTHTGEKPYKCPEC GKSFSRSDKLVRHQRTHTGEKPY KCPECGKSFSQSGDLRRHQRTHT GEKPYKCPECGKSFSRSDKLVRH QRTHTGEKPYKCPECGKSFSQLA HLRAHQRTHTGEKPYKCPECGKS FSRSDKLTEHQRTHTGEKPTGKK TS | 1480 | $X_1X_2X_3X_4X_5X_6X_7X_8X_9CX_{10}X_{11}CX_{12}X_{13}X_{14}X_{15}X_{16}TSGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRH X_{17}X_{18}X_{19}HX_{20}X_{21}X_{22}X_{23}X_{24}X_8X_9CX_{10}X_{11}CX_{12}X_{13}X_{14}X_{15}X_{16}RSDKLV RHX_{17}X_{18}X_{19}HX_{20}X_{21}X_{22}X_{23}X_{24}X_8X_9CX_{10}X_{11}CX_{12}X_{13}X_{14}X_{15}X_{16}QLAH LRAHX_{17}X_{18}X_{19}HX_{20}X_{21}X_{22}X_{23}X_{24}X_8X_9CX_{10}X_{11}CX_{12}X_{13}X_{14}X_{15}X_{16}RS DKLTEHX_{17}X_{18}X_{19}HX_{20}X_{21}X_{22}X_{23}X_{24}X_{25}X_{26}X_{27}X_{28}X_{29}X_{30}$ | 2029 |

TABLE 10-continued

| Column 1<br>Nucleotide Sequence of Target Site in HNF4α Expression Control Region | Column 2<br>Target sequence with space | Column 3<br>Target sequence with space | Column 4<br>SEQ ID NO. (corresponds to sequences in Columns 1 and 3) | Column 5<br>Amino acid Sequence of Zinc Finger DNA Binding Domain Polypeptides Targeting the Target Site in Column 1 | Column 6<br>SEQ ID NO: | Column 7<br>Amino Acid Sequence Structure of Zinc Finger DNA Binding Domain Polypeptides Targeting the Target Site in Column 1 (see Table 1B above and description thereof) | SEQ ID NO: |
|---|---|---|---|---|---|---|---|
| agaggggca gggtggat cac | AGA GGG GCA GGG TGG GAT CAC | | 932 | LEPGEKPYKCPECGKSFSKKAL TEHQRTHTGEKPYKCPECGKSFS TSGNLVRHQRTHTGEKPYKCPEC GKSFSRSDHLTTHQRTHTGEKPY KCPECGKSFSRSDKLVRHQRTHT GEKPYKCPECGKSFSQSGDLRRH QRTHTGEKPYKCPECGKSFSRSD KLVRHQRTHTGEKPYKCPECGKS FSQLAHLRAHQRTHTGEKPTGKK TS | 1481 | $X_1X_2X_3X_4X_5X_6X_7X_8X_9CX_{10}X_{11}CX_{12}X_{13}X_{14}X_{15}X_{16}$SKKALTEH$X_{17}X_{18}X_{19}$H$X_{20}X_{21}X_{22}X_{23}X_{24}X_8X_9CX_{10}X_{11}CX_{12}X_{13}X_{14}X_{15}X_{16}$TSGNLVRH$X_{17}X_{18}$ $X_{19}HX_{20}X_{21}X_{22}X_{23}X_{24}X_8X_9CX_{10}X_{11}CX_{12}X_{13}X_{14}X_{15}X_{16}$RSDHLTTH$X_{17}$ $X_{18}X_{19}HX_{20}X_{21}X_{22}X_{23}X_{24}X_8X_9CX_{10}X_{11}CX_{12}X_{13}X_{14}X_{15}X_{16}$RSDKLVRH $X_{17}X_{18}X_{19}HX_{20}X_{21}X_{22}X_{23}X_{24}X_8X_9CX_{10}X_{11}CX_{12}X_{13}X_{14}X_{15}X_{16}$QSGDLR RH$X_{17}X_{18}X_{19}HX_{20}X_{21}X_{22}X_{23}X_{24}X_8X_9CX_{10}X_{11}CX_{12}X_{13}X_{14}X_{15}X_{16}$RSDK LVRH$X_{17}X_{18}X_{19}HX_{20}X_{21}X_{22}X_{23}X_{24}X_8X_9CX_{10}X_{11}CX_{12}X_{13}X_{14}X_{15}X_{16}$QL AHLRAH$X_{17}X_{18}X_{19}HX_{20}X_{21}X_{22}X_{23}X_{24}X_{25}X_{26}X_{27}X_{28}X_{29}X_{30}$ | 2030 |
| gatcacagg gagcagga cgg | GAT CAC AGG gag CAG gag cgg | | 933 | LEPGEKPYKCPECGKSFSRSDKL TEHQRTHTGEKPYKCPECGKSFS RSDNLVRHQRTHTGEKPYKCPEC GKSFSRADNLTEHQRTHTGEKPY KCPECGKSFSRSDNLVRHQRTHT GEKPYKCPECGKSFSRSDHLTNH QRTHTGEKPYKCPECGKSFSSKK ALTEHQRTHTGEKPYKCPECGKS FSTSGNLVRHQRTHTGEKPTGKK TS | 1482 | $X_1X_2X_3X_4X_5X_6X_7X_8X_9CX_{10}X_{11}CX_{12}X_{13}X_{14}X_{15}X_{16}$RSDKLTEH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$RSDNLVRH$X_{17}X_{18}$ $X_{19}HX_{20}X_{21}X_{22}X_{23}X_{24}X_8X_9CX_{10}X_{11}CX_{12}X_{13}X_{14}X_{15}X_{16}$RADNLTEH$X_{17}$ $X_{18}X_{19}HX_{20}X_{21}X_{22}X_{23}X_{24}X_8X_9CX_{10}X_{11}CX_{12}X_{13}X_{14}X_{15}X_{16}$RSDNLVRH $X_{17}X_{18}X_{19}HX_{20}X_{21}X_{22}X_{23}X_{24}X_8X_9CX_{10}X_{11}CX_{12}X_{13}X_{14}X_{15}X_{16}$RSDHLT NH$X_{17}X_{18}X_{19}HX_{20}X_{21}X_{22}X_{23}X_{24}X_8X_9CX_{10}X_{11}CX_{12}X_{13}X_{14}X_{15}X_{16}$SKKA LTEH$X_{17}X_{18}X_{19}HX_{20}X_{21}X_{22}X_{23}X_{24}X_8X_9CX_{10}X_{11}CX_{12}X_{13}X_{14}X_{15}X_{16}$TS GNLVRH$X_{17}X_{18}X_{19}HX_{20}X_{21}X_{22}X_{23}X_{24}X_{25}X_{26}X_{27}X_{28}X_{29}X_{30}$ | 2031 |
| gggcaggg tgggatcac agg | GGG GCA GGG TGG GAT CAC AGG | | 934 | LEPGEKPYKCPECGKSFSRSDHL TNHQRTHTGEKPYKCPECGKSFS SKKALTEHQRTHTGEKPYKCPEC GKSFSTSGNLVRHQRTHTGEKPY KCPECGKSFSRSDHLTTHQRTHT GEKPYKCPECGKSFSRSDKLVRH QRTHTGEKPYKCPECGKSFSQSG DLRRHQRTHTGEKPYKCPECGKS FSRSDKLVRHQRTHTGEKPTGKK TS | 1483 | $X_1X_2X_3X_4X_5X_6X_7X_8X_9CX_{10}X_{11}CX_{12}X_{13}X_{14}X_{15}X_{16}$RSDHLTNH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$SKKALTEH$X_{17}X_{18}$ $X_{19}HX_{20}X_{21}X_{22}X_{23}X_{24}X_8X_9CX_{10}X_{11}CX_{12}X_{13}X_{14}X_{15}X_{16}$TSGNLVRH$X_{17}$ $X_{18}X_{19}HX_{20}X_{21}X_{22}X_{23}X_{24}X_8X_9CX_{10}X_{11}CX_{12}X_{13}X_{14}X_{15}X_{16}$RSDHLTTH $X_{17}X_{18}X_{19}HX_{20}X_{21}X_{22}X_{23}X_{24}X_8X_9CX_{10}X_{11}CX_{12}X_{13}X_{14}X_{15}X_{16}$RSDKLV RH$X_{17}X_{18}X_{19}HX_{20}X_{21}X_{22}X_{23}X_{24}X_8X_9CX_{10}X_{11}CX_{12}X_{13}X_{14}X_{15}X_{16}$QSGD LRRH$X_{17}X_{18}X_{19}HX_{20}X_{21}X_{22}X_{23}X_{24}X_8X_9CX_{10}X_{11}CX_{12}X_{13}X_{14}X_{15}X_{16}$RS DKLVRH$X_{17}X_{18}X_{19}HX_{20}X_{21}X_{22}X_{23}X_{24}X_{25}X_{26}X_{27}X_{28}X_{29}X_{30}$ | 2032 |
| gggtggat cacaggga cag | GGG TGG GAT CAC AGG gag CAG | | 935 | LEPGEKPYKCPECGKSFSRADNL TEHQRTHTGEKPYKCPECGKSFS RSDNLVRHQRTHTGEKPYKCPEC GKSFSRSDHLTNHQRTHTGEKPY KCPECGKSFSSKKALTEHQRTHT GEKPYKCPECGKSFSTSGNLVRH QRTHTGEKPYKCPECGKSFSRSD HLTTHQRTHTGEKPYKCPECGKS FSRSDKLVRHQRTHTGEKPTGKK TS | 1484 | $X_1X_2X_3X_4X_5X_6X_7X_8X_9CX_{10}X_{11}CX_{12}X_{13}X_{14}X_{15}X_{16}$RADNLTEH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$RSDNLVRH$X_{17}X_{18}$ $X_{19}HX_{20}X_{21}X_{22}X_{23}X_{24}X_8X_9CX_{10}X_{11}CX_{12}X_{13}X_{14}X_{15}X_{16}$RSDHLTNH$X_{17}$ $X_{18}X_{19}HX_{20}X_{21}X_{22}X_{23}X_{24}X_8X_9CX_{10}X_{11}CX_{12}X_{13}X_{14}X_{15}X_{16}$SKKALTEH $X_{17}X_{18}X_{19}HX_{20}X_{21}X_{22}X_{23}X_{24}X_8X_9CX_{10}X_{11}CX_{12}X_{13}X_{14}X_{15}X_{16}$TSGNLV RH$X_{17}X_{18}X_{19}HX_{20}X_{21}X_{22}X_{23}X_{24}X_8X_9CX_{10}X_{11}CX_{12}X_{13}X_{14}X_{15}X_{16}$RSDH LTTH$X_{17}X_{18}X_{19}HX_{20}X_{21}X_{22}X_{23}X_{24}X_8X_9CX_{10}X_{11}CX_{12}X_{13}X_{14}X_{15}X_{16}$RS DKLVRH$X_{17}X_{18}X_{19}HX_{20}X_{21}X_{22}X_{23}X_{24}X_{25}X_{26}X_{27}X_{28}X_{29}X_{30}$ | 2033 |

TABLE 10-continued

| Column 1 Nucleotide Sequence of Target Site in HNF4α Expression Control Region | Column 2 Target sequence with space | Column 3 SEQ ID NO. (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| tgggatcacaggagcaggag | TGG GAT CAC AGG gag CAG GAG | 936 | LEPGEKPYKCPECGKSFSRSDNLVRHQRTHTGEKPYKCPECGKSFSRADNLTEHQRTHTGEKPYKCPECGKSFSRSDNLVRHQRTHTGEKPYKCPECGKSFSRSDHLTNHQRTHTGEKPYKCPECGKSFSSKKALTEHQRTHTGEKPYKCPECGKSFSTSGNLVRHQRTHTGEKPYKCPECGKSFSRSDHLTTHQRTHTGEKPTGKKTS | 1485 | $X_1X_2X_3X_4X_5X_6X_7X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_{25}X_{26}X_{27}X_{28}X_{29}X_{30}$ | 2034 |
| gcagggtggatcacaggag | GCA GGG TGG GAT CAC AGG GAG | 937 | LEPGEKPYKCPECGKSFSRSDNLVRHQRTHTGEKPYKCPECGKSFSRSDHLTNHQRTHTGEKPYKCPECGKSFSSKKALTEHQRTHTGEKPYKCPECGKSFSTSGNLVRHQRTHTGEKPYKCPECGKSFSRSDHLTTHQRTHTGEKPYKCPECGKSFSRSDKLVRHQRTHTGEKPYKCPECGKSFSQSGDLRRHQRTHTGEKPTGKKTS | 1486 | $X_1X_2X_3X_4X_5X_6X_7X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_{25}X_{26}X_{27}X_{28}X_{29}X_{30}$ | 2035 |
| agggagcaggagcggatt | AGG gag CAG gag CGG GGA ATT | 938 | LEPGEKPYKCPECGKSFSHKNALQNHQRTHTGEKPYKCPECGKSFSQRAHLERHQRTHTGEKPYKCPECGKSFSRSDKLTEHQRTHTGEKPYKCPECGKSFSRSDNLVRHQRTHTGEKPYKCPECGKSFSRADNLTEHQRTHTGEKPYKCPECGKSFSRSDNLVRHQRTHTGEKPYKCPECGKSFSRSDHLTNHQRTHTGEKPTGKKTS | 1487 | $X_1X_2X_3X_4X_5X_6X_7X_8X_9CX_{10}X_{11}CX_{12}X_{13}X_{14}X_{15}X_{16}HKNALQNHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_{25}X_{26}X_{27}X_{28}X_{29}X_{30}$ | 2036 |
| cacagggagcaggagcgggga | CAC AGG gag CAG gag CGG GGA | 939 | LEPGEKPYKCPECGKSFSQRAHLERHQRTHTGEKPYKCPECGKSFSRSDKLTEHQRTHTGEKPYKCPECGKSFSRSDNLVRHQRTHTGEKPYKCPECGKSFSRADNLTEHQRTHTGEKPYKCPECGKSFSRSDNLVRHQRTHTGEKPYKCPECGKSFSRSDHLTNHQRTHTGEKPYKCPECGKSFSSKKALTEHQRTHTGEKPTGKKTS | 1488 | $X_1X_2X_3X_4X_5X_6X_7X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_{25}X_{26}X_{27}X_{28}X_{29}X_{30}$ | 2037 |

TABLE 10-continued

| Column 1 Nucleotide Sequence of Target Site in HNF4α Expression Control Region | Column 2 Target sequence with space | Column 3 Target sequence | Column 4 Amino acid Sequence of Zinc Finger DNA Binding Domain Polypeptides Targeting the Target Site in Column 1 | Column 5 SEQ ID NO. (corresponds to sequences in Columns 1 and 3) | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gagcaggag cgggaatt gga | gag CAG gag CGG GGA ATT GGA | 940 | LEPGEKPYKCPECGKSFSQRAHL ERHQRTHTGEKPYKCPECGKSFS HKNALQNHQRTHTGEKPYKCPEC GKSFSQRAHLERHQRTHTGEKPY KCPECGKSFSRSDKLTEHQRTHT GEKPYKCPECGKSFSRSDNLVRH QRTHTGEKPYKCPECGKSFSRAD NLTEHQRTHTGEKPYKCPECGKS FSRSDNLVRHQRTHTGEKPTGKK TS | 1489 | $X_1X_2X_3X_4X_5X_6X_7X_8X_9CX_{10}X_{11}CX_{12}X_{13}X_{14}X_{15}X_{16}QRAHLERHX_{17}X_{18}X_{19}$ $HX_{20}X_{21}X_{22}X_{23}X_{24}X_8X_9CX_{10}X_{11}CX_{12}X_{13}X_{14}X_{15}X_{16}HKNALQNHX_{17}X_{18}$ $X_{19}HX_{20}X_{21}X_{22}X_{23}X_{24}X_8X_9CX_{10}X_{11}CX_{12}X_{13}X_{14}X_{15}X_{16}QRAHLERHX_{17}$ $X_{18}X_{19}HX_{20}X_{21}X_{22}X_{23}X_{24}X_8X_9CX_{10}X_{11}CX_{12}X_{13}X_{14}X_{15}X_{16}RSDKLTEH$ $X_{17}X_{18}X_{19}HX_{20}X_{21}X_{22}X_{23}X_{24}X_8X_9CX_{10}X_{11}CX_{12}X_{13}X_{14}X_{15}X_{16}RSDNLV$ $RHX_{17}X_{18}X_{19}HX_{20}X_{21}X_{22}X_{23}X_{24}X_8X_9CX_{10}X_{11}CX_{12}X_{13}X_{14}X_{15}X_{16}RADN$ $LTEHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DNLVRHX_{17}X_{18}X_{19}HX_{20}X_{21}X_{22}X_{23}X_{24}X_{25}X_{26}X_{27}X_{28}X_{29}X_{30}$ | 2038 |
| caggagcgg ggaattgga ggt | CAG gag CGG GGA ATT GGA GGT | 941 | LEPGEKPYKCPECGKSFSTSGHL VRHQRTHTGEKPYKCPECGKSFS QRAHLERHQRTHTGEKPYKCPEC GKSFSHKNALQNHQRTHTGEKPY KCPECGKSFSQRAHLERHQRTHT GEKPYKCPECGKSFSRSDKLTEH QRTHTGEKPYKCPECGKSFSRSD NLVRHQRTHTGEKPYKCPECGKS FSRADNLTEHQRTHTGEKPTGKK TS | 1490 | $X_1X_2X_3X_4X_5X_6X_7X_8X_9CX_{10}X_{11}CX_{12}X_{13}X_{14}X_{15}X_{16}TSGHLVRHX_{17}X_{18}X_{19}$ $HX_{20}X_{21}X_{22}X_{23}X_{24}X_8X_9CX_{10}X_{11}CX_{12}X_{13}X_{14}X_{15}X_{16}QRAHLERHX_{17}X_{18}$ $X_{19}HX_{20}X_{21}X_{22}X_{23}X_{24}X_8X_9CX_{10}X_{11}CX_{12}X_{13}X_{14}X_{15}X_{16}HKNALQNHX_{17}$ $X_{18}X_{19}HX_{20}X_{21}X_{22}X_{23}X_{24}X_8X_9CX_{10}X_{11}CX_{12}X_{13}X_{14}X_{15}X_{16}QRAHLERH$ $X_{17}X_{18}X_{19}HX_{20}X_{21}X_{22}X_{23}X_{24}X_8X_9CX_{10}X_{11}CX_{12}X_{13}X_{14}X_{15}X_{16}RSDKLT$ $EHX_{17}X_{18}X_{19}HX_{20}X_{21}X_{22}X_{23}X_{24}X_8X_9CX_{10}X_{11}CX_{12}X_{13}X_{14}X_{15}X_{16}RSDN$ $LVRHX_{17}X_{18}X_{19}HX_{20}X_{21}X_{22}X_{23}X_{24}X_8X_9CX_{10}X_{11}CX_{12}X_{13}X_{14}X_{15}X_{16}RA$ $DNLTEHX_{17}X_{18}X_{19}HX_{20}X_{21}X_{22}X_{23}X_{24}X_{25}X_{26}X_{27}X_{28}X_{29}X_{30}$ | 2039 |
| gagcgggga attggaggt gaa | gag CGG GGA ATT GGA GGT GAA | 942 | LEPGEKPYKCPECGKSFSQSSNL VRHQRTHTGEKPYKCPECGKSFS TSGHLVRHQRTHTGEKPYKCPEC GKSFSQRAHLERHQRTHTGEKPY KCPECGKSFSHKNALQNHQRTHT GEKPYKCPECGKSFSQRAHLERH QRTHTGEKPYKCPECGKSFSRSD KLTEHQRTHTGEKPYKCPECGKS FSRSDNLVRHQRTHTGEKPTGKK TS | 1491 | $X_1X_2X_3X_4X_5X_6X_7X_8X_9CX_{10}X_{11}CX_{12}X_{13}X_{14}X_{15}X_{16}QSSNLVRHX_{17}X_{18}X_{19}$ $HX_{20}X_{21}X_{22}X_{23}X_{24}X_8X_9CX_{10}X_{11}CX_{12}X_{13}X_{14}X_{15}X_{16}TSGHLVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}QRAHLERHX_{17}$ $X_{18}X_{19}HX_{20}X_{21}X_{22}X_{23}X_{24}X_8X_9CX_{10}X_{11}CX_{12}X_{13}X_{14}X_{15}X_{16}HKNALQNH$ $X_{17}X_{18}X_{19}HX_{20}X_{21}X_{22}X_{23}X_{24}X_8X_9CX_{10}X_{11}CX_{12}X_{13}X_{14}X_{15}X_{16}QRAHLE$ $RHX_{17}X_{18}X_{19}HX_{20}X_{21}X_{22}X_{23}X_{24}X_8X_9CX_{10}X_{11}CX_{12}X_{13}X_{14}X_{15}X_{16}RSDK$ $LTEHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DNLVRHX_{17}X_{18}X_{19}HX_{20}X_{21}X_{22}X_{23}X_{24}X_{25}X_{26}X_{27}X_{28}X_{29}X_{30}$ | 2040 |
| acacagggagc aggagcgg gaa | ACA ggg AGC AGG AGC GGG GAA | 943 | LEPGEKPYKCPECGKSFSQSSNL VRHQRTHTGEKPYKCPECGKSFS RSDKLVRHQRTHTGEKPYKCPEC GKSFSERSHLREHQRTHTGEKPY KCPECGKSFSRSDHLTNHQRTHT GEKPYKCPECGKSFSERSHLREH QRTHTGEKPYKCPECGKSFSRSD KLVRHQRTHTGEKPYKCPECGKS FSSPADLTRHQRTHTGEKPTGKK TS | 1492 | $X_1X_2X_3X_4X_5X_6X_7X_8X_9CX_{10}X_{11}CX_{12}X_{13}X_{14}X_{15}X_{16}QSSNLVRHX_{17}X_{18}X_{19}$ $HX_{20}X_{21}X_{22}X_{23}X_{24}X_8X_9CX_{10}X_{11}CX_{12}X_{13}X_{14}X_{15}X_{16}RSDKLVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}ERSHLREHX_{17}$ $X_{18}X_{19}HX_{20}X_{21}X_{22}X_{23}X_{24}X_8X_9CX_{10}X_{11}CX_{12}X_{13}X_{14}X_{15}X_{16}RSDHLTNH$ $X_{17}X_{18}X_{19}HX_{20}X_{21}X_{22}X_{23}X_{24}X_8X_9CX_{10}X_{11}CX_{12}X_{13}X_{14}X_{15}X_{16}ERSHLR$ $EHX_{17}X_{18}X_{19}HX_{20}X_{21}X_{22}X_{23}X_{24}X_8X_9CX_{10}X_{11}CX_{12}X_{13}X_{14}X_{15}X_{16}RSDK$ $LVRHX_{17}X_{18}X_{19}HX_{20}X_{21}X_{22}X_{23}X_{24}X_8X_9CX_{10}X_{11}CX_{12}X_{13}X_{14}X_{15}X_{16}SP$ $ADLTRHX_{17}X_{18}X_{19}HX_{20}X_{21}X_{22}X_{23}X_{24}X_{25}X_{26}X_{27}X_{28}X_{29}X_{30}$ | 2041 |

TABLE 10-continued

| Column 1 Nucleotide Sequence of Target Site in HNF4α Expression Control Region | Column 2 Target sequence with space | Column 3 SEQ ID NO. (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gcaggagcggggaattggagg | GCA GGA GCG GGG AAT TGG AGG | 944 | LEPGEKPYKCPECGKSFSRSDHLTNHQRTHTGEKPYKCPECGKSFSRSDHLTTHQRTHTGEKPYKCPECGKSFSTTGNLTVHQRTHTGEKPYKCPECGKSFSRSDKLVRHQRTHTGEKPYKCPECGKSFSRSDDLVRHQRTHTGEKPYKCPECGKSFSQRAHLERHQRTHTGEKPYKCPECGKSFSQSGDLRRHQRTHTGEKPTGKKTS | 1493 | $X_1X_2X_3X_4X_5X_6X_7X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}TTGNLTVHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDDLVRHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_{25}X_{26}X_{27}X_{28}X_{29}X_{30}$ | 2042 |
| ggaggaggaaattggagtga | GGA GCG ggg AAT TGG AGG TGA | 945 | LEPGEKPYKCPECGKSFSQAGHLASHQRTHTGEKPYKCPECGKSFSRSDHLTNHQRTHTGEKPYKCPECGKSFSRSDHLTTHQRTHTGEKPYKCPECGKSFSTTGNLTVHQRTHTGEKPYKCPECGKSFSRSDKLVRHQRTHTGEKPYKCPECGKSFSRSDDLVRHQRTHTGEKPYKCPECGKSFSQRAHLERHQRTHTGEKPTGKKTS | 1494 | $X_1X_2X_3X_4X_5X_6X_7X_8X_9CX_{10}X_{11}CX_{12}X_{13}X_{14}X_{15}X_{16}QAGHLASHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}TTGNLTVHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDDLVRHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_{25}X_{26}X_{27}X_{28}X_{29}X_{30}$ | 2043 |
| cagggagcaggacgggaat | CAG GGA GCA GGA GCG ggg AAT | 946 | LEPGEKPYKCPECGKSFSTTGNLTVHQRTHTGEKPYKCPECGKSFSRSDKLVRHQRTHTGEKPYKCPECGKSFSRSDDLVRHQRTHTGEKPYKCPECGKSFSQRAHLERHQRTHTGEKPYKCPECGKSFSQSGDLRRHQRTHTGEKPYKCPECGKSFSQRAHLERHQRTHTGEKPYKCPECGKSFSRADNLTEHQRTHTGEKPTGKKTS | 1495 | $X_1X_2X_3X_4X_5X_6X_7X_8X_9CX_{10}X_{11}CX_{12}X_{13}X_{14}X_{15}X_{16}TTGNLTVHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDDLVRHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_{25}X_{26}X_{27}X_{28}X_{29}X_{30}$ | 2044 |
| ggaggaggagcgggaattgg | GGA GCA GGA GCG ggg AAT TGG | 947 | LEPGEKPYKCPECGKSFSRSDHLTTHQRTHTGEKPYKCPECGKSFSTTGNLTVHQRTHTGEKPYKCPECGKSFSRSDKLVRHQRTHTGEKPYKCPECGKSFSRSDDLVRHQRTHTGEKPYKCPECGKSFSQRAHLERHQRTHTGEKPYKCPECGKSFSQSGDLRRHQRTHTGEKPYKCPECGKSFSQRAHLERHQRTHTGEKPTGKKTS | 1496 | $X_1X_2X_3X_4X_5X_6X_7X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}TTGNLTVHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDDLVRHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_{25}X_{26}X_{27}X_{28}X_{29}X_{30}$ | 2045 |

TABLE 10-continued

| Column 1 Nucleotide Sequence of Target Site in HNF4α Expression Control Region | Column 2 Target sequence with space | Column 3 SEQ ID NO. (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| ggccctccc aaacttcca gtc | GGC CCT CCC AAA CTT CCA GTC | 948 | LEPGEKPYKCPECGKSFSDPGAL VRHQRTHTGEKPYKCPECGKSFS TSHSLTEHQRTHTGEKPYKCPEC GKSFSTTGALTEHQRTHTGEKPY KCPECGKSFSQRANLRAHQRTHT GEKPYKCPECGKSFSSKKHLAEH QRTHTGEKPYKCPECGKSFSTKN SLTEHQRTHTGEKPYKCPECGKS FSDPGHLVRHQRTHTGEKPTGKK TS | 1497 | $X_1X_2X_3X_4X_5X_6X_7X_8X_9CX_{10}X_{11}CX_{12}X_{13}X_{14}X_{15}X_{16}DPGALVRHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}TTGALTEHX_{17}X_{18}X_{19}HX_{20}X_{21}X_{22}X_{23}X_{24}X_8X_9CX_{10}X_{11}CX_{12}X_{13}X_{14}X_{15}X_{16}QRANLRAH X_{17}X_{18}X_{19}HX_{20}X_{21}X_{22}X_{23}X_{24}X_8X_9CX_{10}X_{11}CX_{12}X_{13}X_{14}X_{15}X_{16}SKKHLA EHX_{17}X_{18}X_{19}HX_{20}X_{21}X_{22}X_{23}X_{24}X_8X_9CX_{10}X_{11}CX_{12}X_{13}X_{14}X_{15}X_{16}TKNS LTEHX_{17}X_{18}X_{19}HX_{20}X_{21}X_{22}X_{23}X_{24}X_8X_9CX_{10}X_{11}CX_{12}X_{13}X_{14}X_{15}X_{16}DP GHLVRHX_{17}X_{18}X_{19}HX_{20}X_{21}X_{22}X_{23}X_{24}X_{25}X_{26}X_{27}X_{28}X_{29}X_{30}$ | 2046 |
| cctcccaaa cttccagtc cat | CCT CCC AAA CTT CCA GTC CAT | 949 | LEPGEKPYKCPECGKSFSTSGNL TEHQRTHTGEKPYKCPECGKSFS DPGALVRHQRTHTGEKPYKCPEC GKSFSTSHSLTEHQRTHTGEKPY KCPECGKSFSTTGALTEHQRTHT GEKPYKCPECGKSFSQRANLRAH QRTHTGEKPYKCPECGKSFSSKK HLAEHQRTHTGEKPYKCPECGKS FSTKNSLTEHQRTHTGEKPTGKK TS | 1498 | $X_1X_2X_3X_4X_5X_6X_7X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}DPGALVRHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}TTGALTEH X_{17}X_{18}X_{19}HX_{20}X_{21}X_{22}X_{23}X_{24}X_8X_9CX_{10}X_{11}CX_{12}X_{13}X_{14}X_{15}X_{16}QRANLR AHX_{17}X_{18}X_{19}HX_{20}X_{21}X_{22}X_{23}X_{24}X_8X_9CX_{10}X_{11}CX_{12}X_{13}X_{14}X_{15}X_{16}SKKH LAEHX_{17}X_{18}X_{19}HX_{20}X_{21}X_{22}X_{23}X_{24}X_8X_9CX_{10}X_{11}CX_{12}X_{13}X_{14}X_{15}X_{16}TK NSLTEHX_{17}X_{18}X_{19}HX_{20}X_{21}X_{22}X_{23}X_{24}X_{25}X_{26}X_{27}X_{28}X_{29}X_{30}$ | 2047 |
| gggaaactg cggggaac tgg | ggg AAA CTG CGG gga AAC TGG | 950 | LEPGEKPYKCPECGKSFSRSDHL TTHQRTHTGEKPYKCPECGKSFS DSGNLRVHQRTHTGEKPYKCPEC GKSFSRSDKLVRHQRTHTGEKPY KCPECGKSFSRSDKLTEHQRTHT GEKPYKCPECGKSFSRNDALTEH QRTHTGEKPYKCPECGKSFSQRA NLRAHQRTHTGEKPYKCPECGKS FSRSDKLVRHQRTHTGEKPTGKK TS | 1499 | $X_1X_2X_3X_4X_5X_6X_7X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}DSGNLRVHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLTEH X_{17}X_{18}X_{19}HX_{20}X_{21}X_{22}X_{23}X_{24}X_8X_9CX_{10}X_{11}CX_{12}X_{13}X_{14}X_{15}X_{16}RNDALT EHX_{17}X_{18}X_{19}HX_{20}X_{21}X_{22}X_{23}X_{24}X_8X_9CX_{10}X_{11}CX_{12}X_{13}X_{14}X_{15}X_{16}QRAN LRAHX_{17}X_{18}X_{19}HX_{20}X_{21}X_{22}X_{23}X_{24}X_8X_9CX_{10}X_{11}CX_{12}X_{13}X_{14}X_{15}X_{16}RS DKLVRHX_{17}X_{18}X_{19}HX_{20}X_{21}X_{22}X_{23}X_{24}X_{25}X_{26}X_{27}X_{28}X_{29}X_{30}$ | 2048 |
| accgggaaa ctgcgggga aac | ACC ggg AAA CTG CGG ggg AAC | 951 | LEPGEKPYKCPECGKSFSDSGNL RVHQRTHTGEKPYKCPECGKSFS RSDKLVRHQRTHTGEKPYKCPEC GKSFSRSDKLTEHQRTHTGEKPY KCPECGKSFSRNDALTEHQRTHT GEKPYKCPECGKSFSQRANLRAH QRTHTGEKPYKCPECGKSFSRSD KLVRHQRTHTGEKPYKCPECGKS FSDKKDLTRHQRTHTGEKPTGKK TS | 1500 | $X_1X_2X_3X_4X_5X_6X_7X_8X_9CX_{10}X_{11}CX_{12}X_{13}X_{14}X_{15}X_{16}DSGNLRVHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLTEHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEH X_{17}X_{18}X_{19}HX_{20}X_{21}X_{22}X_{23}X_{24}X_8X_9CX_{10}X_{11}CX_{12}X_{13}X_{14}X_{15}X_{16}QRANLR AHX_{17}X_{18}X_{19}HX_{20}X_{21}X_{22}X_{23}X_{24}X_8X_9CX_{10}X_{11}CX_{12}X_{13}X_{14}X_{15}X_{16}RSDK LVRHX_{17}X_{18}X_{19}HX_{20}X_{21}X_{22}X_{23}X_{24}X_8X_9CX_{10}X_{11}CX_{12}X_{13}X_{14}X_{15}X_{16}DK KDLTRHX_{17}X_{18}X_{19}HX_{20}X_{21}X_{22}X_{23}X_{24}X_{25}X_{26}X_{27}X_{28}X_{29}X_{30}$ | 2049 |

TABLE 10-continued

| Column 1 Nucleotide Sequence of Target Site in HNF4α Expression Control Region | Column 2 Target sequence with space | Column 3 Target sequence | Column 4 Amino acid Sequence of Zinc Finger DNA Binding Domain Polypeptides Targeting the Target Site in Column 1 | Column 5 SEQ ID NO. (corresponds to sequences in Columns 2 and 3) | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| aaactgcgg gggaactgg aag | AAA CTG CGG ggg AAC TGG AAG | 952 | LEPGEKPYKCPECGKSFSRKDNL KNHQRTHTGEKPYKCPECGKSFS RSDHLTTHQRTHTGEKPYKCPEC GKSFSDSGNLRVHQRTHTGEKPY KCPECGKSFSRSDKLVRHQRTHT GEKPYKCPECGKSFSRSDKLTEH QRTHTGEKPYKCPECGKSFSRND ALTEHQRTHTGEKPYKCPECGKS FSQRANLRAHQRTHTGEKPTGKK TS | 1501 | $X_1X_2X_3X_4X_5X_6X_7X_8X_9CX_{10}X_{11}CX_{12}X_{13}X_{14}X_{15}X_{16}RKDNLKNHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}DSGNLRVHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRH X_{17}X_{18}X_{19}HX_{20}X_{21}X_{22}X_{23}X_{24}X_8X_9CX_{10}X_{11}CX_{12}X_{13}X_{14}X_{15}X_{16}RSDKLT EHX_{17}X_{18}X_{19}HX_{20}X_{21}X_{22}X_{23}X_{24}X_8X_9CX_{10}X_{11}CX_{12}X_{13}X_{14}X_{15}X_{16}RNDA LTEHX_{17}X_{18}X_{19}HX_{20}X_{21}X_{22}X_{23}X_{24}X_8X_9CX_{10}X_{11}CX_{12}X_{13}X_{14}X_{15}X_{16}QR ANLRAHX_{17}X_{18}X_{19}HX_{20}X_{21}X_{22}X_{23}X_{24}X_{25}X_{26}X_{27}X_{28}X_{29}X_{30}$ | 2050 |
| ggaaccggg aaactgcgg ggg | GGA ACC ggg AAA CTG CGG GGG | 953 | LEPGEKPYKCPECGKSFSRSDKL VRHQRTHTGEKPYKCPECGKSFS RSDKLTEHQRTHTGEKPYKCPEC GKSFSRNDALTEHQRTHTGEKPY KCPECGKSFSQRANLRAHQRTHT GEKPYKCPECGKSFSRSDKLVRH QRTHTGEKPYKCPECGKSFSDKK DLTRHQRTHTGEKPYKCPECGKS FSQRAHLERHQRTHTGEKPTGKK TS | 1502 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLTEHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}QRANLRAH X_{17}X_{18}X_{19}HX_{20}X_{21}X_{22}X_{23}X_{24}X_8X_9CX_{10}X_{11}CX_{12}X_{13}X_{14}X_{15}X_{16}RSDKLV RHX_{17}X_{18}X_{19}HX_{20}X_{21}X_{22}X_{23}X_{24}X_8X_9CX_{10}X_{11}CX_{12}X_{13}X_{14}X_{15}X_{16}DKKD LTRHX_{17}X_{18}X_{19}HX_{20}X_{21}X_{22}X_{23}X_{24}X_8X_9CX_{10}X_{11}CX_{12}X_{13}X_{14}X_{15}X_{16}QR AHLERHX_{17}X_{18}X_{19}HX_{20}X_{21}X_{22}X_{23}X_{24}X_{25}X_{26}X_{27}X_{28}X_{29}X_{30}$ | 2051 |
| agggaacc gggaactg cgg | AGG GGA ACC ggg AAA CTG CGG | 954 | LEPGEKPYKCPECGKSFSRSDKL TEHQRTHTGEKPYKCPECGKSFS RNDALTEHQRTHTGEKPYKCPEC GKSFSQRANLRAHQRTHTGEKPY KCPECGKSFSRSDKLVRHQRTHT GEKPYKCPECGKSFSDKKDLTRH QRTHTGEKPYKCPECGKSFSQRA HLERHQRTHTGEKPYKCPECGKS FSRSDHLTNHQRTHTGEKPTGKK TS | 1503 | $X_1X_2X_3X_4X_5X_6X_7X_8X_9CX_{10}X_{11}CX_{12}X_{13}X_{14}X_{15}X_{16}RSDKLTEHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}QRANLRAHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRH X_{17}X_{18}X_{19}HX_{20}X_{21}X_{22}X_{23}X_{24}X_8X_9CX_{10}X_{11}CX_{12}X_{13}X_{14}X_{15}X_{16}DKKDLT RHX_{17}X_{18}X_{19}HX_{20}X_{21}X_{22}X_{23}X_{24}X_8X_9CX_{10}X_{11}CX_{12}X_{13}X_{14}X_{15}X_{16}QRAH LERHX_{17}X_{18}X_{19}HX_{20}X_{21}X_{22}X_{23}X_{24}X_8X_9CX_{10}X_{11}CX_{12}X_{13}X_{14}X_{15}X_{16}RS DHLTNHX_{17}X_{18}X_{19}HX_{20}X_{21}X_{22}X_{23}X_{24}X_{25}X_{26}X_{27}X_{28}X_{29}X_{30}$ | 2052 |
| ctgcgggg aactggaag gga | CTG CGG ggg AAC TGG AAG GGA | 955 | LEPGEKPYKCPECGKSFSQRAHL ERHQRTHTGEKPYKCPECGKSFS RKDNLKNHQRTHTGEKPYKCPEC GKSFSRSDHLTTHQRTHTGEKPY KCPECGKSFSDSGNLRVHQRTHT GEKPYKCPECGKSFSRSDKLVRH QRTHTGEKPYKCPECGKSFSRSD KLTEHQRTHTGEKPYKCPECGKS FSRNDALTEHQRTHTGEKPTGKK TS | 1504 | $X_1X_2X_3X_4X_5X_6X_7X_8X_9CX_{10}X_{11}CX_{12}X_{13}X_{14}X_{15}X_{16}QPAHLERHX_{17}X_{18}X_{19}HX_{20}X_{21}X_{22}X_{23}X_{24}X_8X_9CX_{10}X_{11}CX_{12}X_{13}X_{14}X_{15}X_{16}RKDNLKNHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}DSGNLRVH X_{17}X_{18}X_{19}HX_{20}X_{21}X_{22}X_{23}X_{24}X_8X_9CX_{10}X_{11}CX_{12}X_{13}X_{14}X_{15}X_{16}RSDKLV RHX_{17}X_{18}X_{19}HX_{20}X_{21}X_{22}X_{23}X_{24}X_8X_9CX_{10}X_{11}CX_{12}X_{13}X_{14}X_{15}X_{16}RSDK LTEHX_{17}X_{18}X_{19}HX_{20}X_{21}X_{22}X_{23}X_{24}X_8X_9CX_{10}X_{11}CX_{12}X_{13}X_{14}X_{15}X_{16}RN DALTEHX_{17}X_{18}X_{19}HX_{20}X_{21}X_{22}X_{23}X_{24}X_{25}X_{26}X_{27}X_{28}X_{29}X_{30}$ | 2053 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| cggggaac tggaagga gct | 956 | CGG ggg AAC TGG AAG GGA GCT | LEPGEKPYKCPECGKSFSTSGEL VRHQRTHTGEKPYKCPECGKSFS QRAHLERHQRTHTGEKPYKCPEC GKSFSRKDNLKNHQRTHTGEKPY KCPECGKSFSRSDHLTTHQRTHT GEKPYKCPECGKSFSDSGNLRVH QRTHTGEKPYKCPECGKSFSRSD KLVRHQRTHTGEKPYKCPECGKS FSRSDKLTEHQRTHTGEKPTGKK TS | 1505 | $X_1X_2X_3X_4X_5X_6X_7X_8X_9CX_{10}X_{11}CX_{12}X_{13}X_{14}X_{15}X_{16}$TSGELVRH$X_{17}X_{18}X_{19}$HX$_{20}X_{21}X_{22}X_{23}X_{24}X_8X_9CX_{10}X_{11}CX_{12}X_{13}X_{14}X_{15}X_{16}$QRAHLERH$X_{17}X_{18}X_{19}$HX$_{20}X_{21}X_{22}X_{23}X_{24}X_8X_9CX_{10}X_{11}CX_{12}X_{13}X_{14}X_{15}X_{16}$RKDNLKNH$X_{17}X_{18}X_{19}$HX$_{20}X_{21}X_{22}X_{23}X_{24}X_8X_9CX_{10}X_{11}CX_{12}X_{13}X_{14}X_{15}X_{16}$RSDHLTTH$X_{17}X_{18}X_{19}$HX$_{20}X_{21}X_{22}X_{23}X_{24}X_8X_9CX_{10}X_{11}CX_{12}X_{13}X_{14}X_{15}X_{16}$DSGNLRVH$X_{17}X_{18}X_{19}$HX$_{20}X_{21}X_{22}X_{23}X_{24}X_8X_9CX_{10}X_{11}CX_{12}X_{13}X_{14}X_{15}X_{16}$RSDKLVRH$X_{17}X_{18}X_{19}$HX$_{20}X_{21}X_{22}X_{23}X_{24}X_8X_9CX_{10}X_{11}CX_{12}X_{13}X_{14}X_{15}X_{16}$RSDKLTEH$X_{17}X_{18}X_{19}$HX$_{20}X_{21}X_{22}X_{23}X_{24}X_{25}X_{26}X_{27}X_{28}X_{29}X_{30}$ | 2054 |
| cccaggga accgggaaa ctg | 957 | CCC AGG GGA ACC ggg AAA CTG | LEPGEKPYKCPECGKSFSRNDAL TEHQRTHTGEKPYKCPECGKSFS QRANLRAHQRTHTGEKPYKCPEC GKSFSRSDKLVRHQRTHTGEKPY KCPECGKSFSDKKDLTRHQRTHT GEKPYKCPECGKSFSQRAHLERH QRTHTGEKPYKCPECGKSFSRSD HLTNHQRTHTGEKPYKCPECGKS FSSKKHLAEHQRTHTGEKPTGKK TS | 1506 | $X_1X_2X_3X_4X_5X_6X_7X_8X_9CX_{10}X_{11}CX_{12}X_{13}X_{14}X_{15}X_{16}$RNDALTEH$X_{17}X_{18}X_{19}$HX$_{20}X_{21}X_{22}X_{23}X_{24}X_8X_9CX_{10}X_{11}CX_{12}X_{13}X_{14}X_{15}X_{16}$QRANLRAH$X_{17}X_{18}X_{19}$HX$_{20}X_{21}X_{22}X_{23}X_{24}X_8X_9CX_{10}X_{11}CX_{12}X_{13}X_{14}X_{15}X_{16}$RSDKLVRH$X_{17}X_{18}X_{19}$HX$_{20}X_{21}X_{22}X_{23}X_{24}X_8X_9CX_{10}X_{11}CX_{12}X_{13}X_{14}X_{15}X_{16}$DKKDLTRH$X_{17}X_{18}X_{19}$HX$_{20}X_{21}X_{22}X_{23}X_{24}X_8X_9CX_{10}X_{11}CX_{12}X_{13}X_{14}X_{15}X_{16}$QRAHLERH$X_{17}X_{18}X_{19}$HX$_{20}X_{21}X_{22}X_{23}X_{24}X_8X_9CX_{10}X_{11}CX_{12}X_{13}X_{14}X_{15}X_{16}$RSDHLTNH$X_{17}X_{18}X_{19}$HX$_{20}X_{21}X_{22}X_{23}X_{24}X_8X_9CX_{10}X_{11}CX_{12}X_{13}X_{14}X_{15}X_{16}$SKKHLAEH$X_{17}X_{18}X_{19}$HX$_{20}X_{21}X_{22}X_{23}X_{24}X_{25}X_{26}X_{27}X_{28}X_{29}X_{30}$ | 2055 |
| gctcccagg ggaaccggg aaa | 958 | GCT CCC AGG GGA ACC ggg AAA | LEPGEKPYKCPECGKSFSQRANL RAHQRTHTGEKPYKCPECGKSFS RSDKLVRHQRTHTGEKPYKCPEC GKSFSDKKDLTRHQRTHTGEKPY KCPECGKSFSQRAHLERHQRTHT GEKPYKCPECGKSFSRSDHLTNH QRTHTGEKPYKCPECGKSFSSKK HLAEHQRTHTGEKPYKCPECGKS FSTSGELVRHQRTHTGEKPTGKK TS | 1507 | $X_1X_2X_3X_4X_5X_6X_7X_8X_9CX_{10}X_{11}CX_{12}X_{13}X_{14}X_{15}X_{16}$QRANLRAH$X_{17}X_{18}X_{19}$HX$_{20}X_{21}X_{22}X_{23}X_{24}X_8X_9CX_{10}X_{11}CX_{12}X_{13}X_{14}X_{15}X_{16}$RSDKLVRH$X_{17}X_{18}X_{19}$HX$_{20}X_{21}X_{22}X_{23}X_{24}X_8X_9CX_{10}X_{11}CX_{12}X_{13}X_{14}X_{15}X_{16}$DKKDLTRH$X_{17}X_{18}X_{19}$HX$_{20}X_{21}X_{22}X_{23}X_{24}X_8X_9CX_{10}X_{11}CX_{12}X_{13}X_{14}X_{15}X_{16}$QRAHLERH$X_{17}X_{18}X_{19}$HX$_{20}X_{21}X_{22}X_{23}X_{24}X_8X_9CX_{10}X_{11}CX_{12}X_{13}X_{14}X_{15}X_{16}$RSDHLT NH$X_{17}X_{18}X_{19}$HX$_{20}X_{21}X_{22}X_{23}X_{24}X_8X_9CX_{10}X_{11}CX_{12}X_{13}X_{14}X_{15}X_{16}$SKKHLAEH$X_{17}X_{18}X_{19}$HX$_{20}X_{21}X_{22}X_{23}X_{24}X_8X_9CX_{10}X_{11}CX_{12}X_{13}X_{14}X_{15}X_{16}$TSGELVRH$X_{17}X_{18}X_{19}$HX$_{20}X_{21}X_{22}X_{23}X_{24}X_{25}X_{26}X_{27}X_{28}X_{29}X_{30}$ | 2056 |
| gggaactgg aaggagct ccc | 959 | ggg AAC TGG AAG GGA GCT CCC | LEPGEKPYKCPECGKSFSSKKHL AEHQRTHTGEKPYKCPECGKSFS TSGELVRHQRTHTGEKPYKCPEC GKSFSQRAHLERHQRTHTGEKPY KCPECGKSFSRKDNLKNHQRTHT GEKPYKCPECGKSFSRSDHLTTH QRTHTGEKPYKCPECGKSFSDSG NLRVHQRTHTGEKPYKCPECGKS FSRSDKLVRHQRTHTGEKPTGKK TS | 1508 | $X_1X_2X_3X_4X_5X_6X_7X_8X_9CX_{10}X_{11}CX_{12}X_{13}X_{14}X_{15}X_{16}$SKKHLAEH$X_{17}X_{18}X_{19}$HX$_{20}X_{21}X_{22}X_{23}X_{24}X_8X_9CX_{10}X_{11}CX_{12}X_{13}X_{14}X_{15}X_{16}$TSGELVRH$X_{17}X_{18}X_{19}$HX$_{20}X_{21}X_{22}X_{23}X_{24}X_8X_9CX_{10}X_{11}CX_{12}X_{13}X_{14}X_{15}X_{16}$QRAHLERH$X_{17}X_{18}X_{19}$HX$_{20}X_{21}X_{22}X_{23}X_{24}X_8X_9CX_{10}X_{11}CX_{12}X_{13}X_{14}X_{15}X_{16}$RKDNLKNH$X_{17}X_{18}X_{19}$HX$_{20}X_{21}X_{22}X_{23}X_{24}X_8X_9CX_{10}X_{11}CX_{12}X_{13}X_{14}X_{15}X_{16}$RSDHLTTH$X_{17}X_{18}X_{19}$HX$_{20}X_{21}X_{22}X_{23}X_{24}X_8X_9CX_{10}X_{11}CX_{12}X_{13}X_{14}X_{15}X_{16}$DSGNLRVH$X_{17}X_{18}X_{19}$HX$_{20}X_{21}X_{22}X_{23}X_{24}X_8X_9CX_{10}X_{11}CX_{12}X_{13}X_{14}X_{15}X_{16}$RSDKLVRH$X_{17}X_{18}X_{19}$HX$_{20}X_{21}X_{22}X_{23}X_{24}X_{25}X_{26}X_{27}X_{28}X_{29}X_{30}$ | 2057 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| aactggaag gggctcccc aga | 960 | AAC TGG AAG GGA GCT CCC AGA | LEPGEKPYKCPECGKSFSQLAHL RAHQRTHTGEKPYKCPECGKSFS SKKHLAEHQRTHTGEKPYKCPEC GKSFSTSGELVRHQRTHTGEKPY KCPECGKSFSQRAHLERHQRTHT GEKPYKCPECGKSFSRKDNLKNH QRTHTGEKPYKCPECGKSFSRSD HLTTHQRTHTGEKPYKCPECGKS FSDSGNLRVHQRTHTGEKPTGKK TS | 1509 | $X_1X_2X_3X_4X_5X_6X_7X_8X_9CX_{10}X_{11}CX_{12}X_{13}X_{14}X_{15}X_{16}QLAHLRAHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}TSGELVRHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERH X_{17}X_{18}X_{19}HX_{20}X_{21}X_{22}X_{23}X_{24}X_8X_9CX_{10}X_{11}CX_{12}X_{13}X_{14}X_{15}X_{16}RKDNLK NHX_{17}X_{18}X_{19}HX_{20}X_{21}X_{22}X_{23}X_{24}X_8X_9CX_{10}X_{11}CX_{12}X_{13}X_{14}X_{15}X_{16}RSDH LTTHX_{17}X_{18}X_{19}HX_{20}X_{21}X_{22}X_{23}X_{24}X_8X_9CX_{10}X_{11}CX_{12}X_{13}X_{14}X_{15}X_{16}DS GNLRVHX_{17}X_{18}X_{19}HX_{20}X_{21}X_{22}X_{23}X_{24}X_{25}X_{26}X_{27}X_{28}X_{29}X_{30}$ | 2058 |
| tggaaggga gctcccaga aca | 961 | TGG AAG GGA GCT CCC AGA ACA | LEPGEKPYKCPECGKSFSSPADL TRHQRTHTGEKPYKCPECGKSFS QLAHLRAHQRTHTGEKPYKCPEC GKSFSSKKHLAEHQRTHTGEKPY KCPECGKSFSTSGELVRHQRTHT GEKPYKCPECGKSFSQRAHLERH QRTHTGEKPYKCPECGKSFSRKD NLKNHQRTHTGEKPYKCPECGKS FSRSDHLTTHQRTHTGEKPTGKK TS | 1510 | $X_1X_2X_3X_4X_5X_6X_7X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}QLAHLRAHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}TSGELVRH X_{17}X_{18}X_{19}HX_{20}X_{21}X_{22}X_{23}X_{24}X_8X_9CX_{10}X_{11}CX_{12}X_{13}X_{14}X_{15}X_{16}QRAHLE RHX_{17}X_{18}X_{19}HX_{20}X_{21}X_{22}X_{23}X_{24}X_8X_9CX_{10}X_{11}CX_{12}X_{13}X_{14}X_{15}X_{16}RKDN LKNHX_{17}X_{18}X_{19}HX_{20}X_{21}X_{22}X_{23}X_{24}X_8X_9CX_{10}X_{11}CX_{12}X_{13}X_{14}X_{15}X_{16}RS DHLTTHX_{17}X_{18}X_{19}HX_{20}X_{21}X_{22}X_{23}X_{24}X_{25}X_{26}X_{27}X_{28}X_{29}X_{30}$ | 2059 |
| aagggagct cccagaaca agg | 962 | AAG GGA GCT CCC AGA ACA AGG | LEPGEKPYKCPECGKSFSRSDHL TNHQRTHTGEKPYKCPECGKSFS SPADLTRHQRTHTGEKPYKCPEC GKSFSQLAHLRAHQRTHTGEKPY KCPECGKSFSSKKHLAEHQRTHT GEKPYKCPECGKSFSTSGELVRH QRTHTGEKPYKCPECGKSFSQRA HLERHQRTHTGEKPYKCPECGKS FSRKDNLKNHQRTHTGEKPTGKK TS | 1511 | $X_1X_2X_3X_4X_5X_6X_7X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}QLAHLRAHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEH X_{17}X_{18}X_{19}HX_{20}X_{21}X_{22}X_{23}X_{24}X_8X_9CX_{10}X_{11}CX_{12}X_{13}X_{14}X_{15}X_{16}TSGELV RHX_{17}X_{18}X_{19}HX_{20}X_{21}X_{22}X_{23}X_{24}X_8X_9CX_{10}X_{11}CX_{12}X_{13}X_{14}X_{15}X_{16}QRAH LERHX_{17}X_{18}X_{19}HX_{20}X_{21}X_{22}X_{23}X_{24}X_8X_9CX_{10}X_{11}CX_{12}X_{13}X_{14}X_{15}X_{16}RK DNLKNHX_{17}X_{18}X_{19}HX_{20}X_{21}X_{22}X_{23}X_{24}X_{25}X_{26}X_{27}X_{28}X_{29}X_{30}$ | 2060 |
| cagggaaac cgggaaact gcg | 963 | CAG ggg AAC CGG GAA ACT GCG | LEPGEKPYKCPECGKSFSRSDDL VRHQRTHTGEKPYKCPECGKSFS THLDLIRHQRTHTGEKPYKCPEC GKSFSQSSNLVRHQRTHTGEKPY KCPECGKSFSRSDKLTEHQRTHT GEKPYKCPECGKSFSDSGNLRVH QRTHTGEKPYKCPECGKSFSRSD KLVRHQRTHTGEKPYKCPECGKS FSRADNLTEHQRTHTGEKPTGKK TS | 1512 | $X_1X_2X_3X_4X_5X_6X_7X_8X_9CX_{10}X_{11}CX_{12}X_{13}X_{14}X_{15}X_{16}RSDDLVRHX_{17}X_{18}X_{19}HX_{20}X_{21}X_{22}X_{23}X_{24}X_8X_9CX_{10}X_{11}CX_{12}X_{13}X_{14}X_{15}X_{16}THLDLIRHX_{17}X_{18}X_{19}HX_{20}X_{21}X_{22}X_{23}X_{24}X_8X_9CX_{10}X_{11}CX_{12}X_{13}X_{14}X_{15}X_{16}QSSNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLTEH X_{17}X_{18}X_{19}HX_{20}X_{21}X_{22}X_{23}X_{24}X_8X_9CX_{10}X_{11}CX_{12}X_{13}X_{14}X_{15}X_{16}DSGNLR VHX_{17}X_{18}X_{19}HX_{20}X_{21}X_{22}X_{23}X_{24}X_8X_9CX_{10}X_{11}CX_{12}X_{13}X_{14}X_{15}X_{16}RSDK LVRHX_{17}X_{18}X_{19}HX_{20}X_{21}X_{22}X_{23}X_{24}X_8X_9CX_{10}X_{11}CX_{12}X_{13}X_{14}X_{15}X_{16}RA DNLTEHX_{17}X_{18}X_{19}HX_{20}X_{21}X_{22}X_{23}X_{24}X_{25}X_{26}X_{27}X_{28}X_{29}X_{30}$ | 2061 |

TABLE 10-continued

| Column 1 Nucleotide Sequence of Target Site in HNF4α Expression Control Region | Column 2 Target sequence with space | Column 3 Target sequence | Column 4 Amino acid Sequence of Zinc Finger DNA Binding Domain Polypeptides Targeting the Target Site in Column 1 | Column 5 SEQ ID NO. (corresponds to sequences in Columns 1 and 3) | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gggaaccgg gaactgcg ggg | ggg AAC CGG GAA ACT GCG GGG | 964 | LEPGEKPYKCPECGKSFSRSDKL VRHQRTHTGEKPYKCPECGKSFS RSDDLVRHQRTHTGEKPYKCPEC GKSFSTHLDLIRHQRTHTGEKPY KCPECGKSFSQSSNLVRHQRTHT GEKPYKCPECGKSFSRSDKLTEH QRTHTGEKPYKCPECGKSFSDSG NLRVHQRTHTGEKPYKCPECGKS FSRSDKLVRHQRTHTGEKPTGKK TS | 1513 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}$ $HX_{20}X_{21}X_{22}X_{23}X_{24}X_8X_9CX_{10}X_{11}CX_{12}X_{13}X_{14}X_{15}X_{16}RSDDLVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}THLDLTRHX_{17}$ $X_{18}X_{19}HX_{20}X_{21}X_{22}X_{23}X_{24}X_8X_9CX_{10}X_{11}CX_{12}X_{13}X_{14}X_{15}X_{16}QSSNLVRH$ $X_{17}X_{18}X_{19}HX_{20}X_{21}X_{22}X_{23}X_{24}X_8X_9CX_{10}X_{11}CX_{12}X_{13}X_{14}X_{15}X_{16}RSDKLT$ $EHX_{17}X_{18}X_{19}HX_{20}X_{21}X_{22}X_{23}X_{24}X_8X_9CX_{10}X_{11}CX_{12}X_{13}X_{14}X_{15}X_{16}DSGN$ $LRVHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DKLVRHX_{17}X_{18}X_{19}HX_{20}X_{21}X_{22}X_{23}X_{24}X_{25}X_{26}X_{27}X_{28}X_{29}X_{30}$ | 2062 |
| aaccgggaa actgcgggg gaa | AAC CGG GAA ACT GCG GGG GAA | 965 | LEPGEKPYKCPECGKSFSQSSNL VRHQRTHTGEKPYKCPECGKSFS RSDKLVRHQRTHTGEKPYKCPEC GKSFSRSDDLVRHQRTHTGEKPY KCPECGKSFSTHLDLIRHQRTHT GEKPYKCPECGKSFSQSSNLVRH QRTHTGEKPYKCPECGKSFSRSD KLTEHQRTHTGEKPYKCPECGKS FSDSGNLRVHQRTHTGEKPTGKK TS | 1514 | $X_1X_2X_3X_4X_5X_6X_7X_8X_9CX_{10}X_{11}CX_{12}X_{13}X_{14}X_{15}X_{16}QSSNLVRHX_{17}X_{18}X_{19}$ $HX_{20}X_{21}X_{22}X_{23}X_{24}X_8X_9CX_{10}X_{11}CX_{12}X_{13}X_{14}X_{15}X_{16}RSDKLVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}RSDDLVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}THLDLIRH$ $X_{17}X_{18}X_{19}HX_{20}X_{21}X_{22}X_{23}X_{24}X_8X_9CX_{10}X_{11}CX_{12}X_{13}X_{14}X_{15}X_{16}QSSNLV$ $RHX_{17}X_{18}X_{19}HX_{20}X_{21}X_{22}X_{23}X_{24}X_8X_9CX_{10}X_{11}CX_{12}X_{13}X_{14}X_{15}X_{16}RSDK$ $LTEHX_{17}X_{18}X_{19}HX_{20}X_{21}X_{22}X_{23}X_{24}X_8X_9CX_{10}X_{11}CX_{12}X_{13}X_{14}X_{15}X_{16}DS$ $GNLRVHX_{17}X_{18}X_{19}HX_{20}X_{21}X_{22}X_{23}X_{24}X_{25}X_{26}X_{27}X_{28}X_{29}X_{30}$ | 2063 |
| gcggggaa ctggaaggg agc | GCG GGG GAA CTG GAA ggg AGC | 966 | LEPGEKPYKCPECGKSFSERSHL REHQRTHTGEKPYKCPECGKSFS RSDKLVRHQRTHTGEKPYKCPEC GKSFSQSSNLVRHQRTHTGEKPY KCPECGKSFSRNDALTEHQRTHT GEKPYKCPECGKSFSQSSNLVRH QRTHTGEKPYKCPECGKSFSRSD KLVRHQRTHTGEKPYKCPECGKS FSRSDDLVRHQRTHTGEKPTGKK TS | 1515 | $X_1X_2X_3X_4X_5X_6X_7X_8X_9CX_{10}X_{11}CX_{12}X_{13}X_{14}X_{15}X_{16}ERSHLREHX_{17}X_{18}X_{19}$ $HX_{20}X_{21}X_{22}X_{23}X_{24}X_8X_9CX_{10}X_{11}CX_{12}X_{13}X_{14}X_{15}X_{16}RSDKLVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}QSSNLVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}RNDALTEH$ $X_{17}X_{18}X_{19}HX_{20}X_{21}X_{22}X_{23}X_{24}X_8X_9CX_{10}X_{11}CX_{12}X_{13}X_{14}X_{15}X_{16}QSSNLV$ $RHX_{17}X_{18}X_{19}HX_{20}X_{21}X_{22}X_{23}X_{24}X_8X_9CX_{10}X_{11}CX_{12}X_{13}X_{14}X_{15}X_{16}RSDK$ $LVRHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DDLVRHX_{17}X_{18}X_{19}HX_{20}X_{21}X_{22}X_{23}X_{24}X_{25}X_{26}X_{27}X_{28}X_{29}X_{30}$ | 2064 |
| actgcgggg gaactggaa ggg | ACT GCG GGG GAA CTG GAA GGG | 967 | LEPGEKPYKCPECGKSFSRSDKL VRHQRTHTGEKPYKCPECGKSFS QSSNLVRHQRTHTGEKPYKCPEC GKSFSRNDALTEHQRTHTGEKPY KCPECGKSFSQSSNLVRHQRTHT GEKPYKCPECGKSFSRSDKLVRH QRTHTGEKPYKCPECGKSFSRSD DLVRHQRTHTGEKPYKCPECGKS FSTHLDLIRHQRTHTGEKPTGKK TS | 1516 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}$ $HX_{20}X_{21}X_{22}X_{23}X_{24}X_8X_9CX_{10}X_{11}CX_{12}X_{13}X_{14}X_{15}X_{16}QSSNLVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}RNDALTEHX_{17}$ $X_{18}X_{19}HX_{20}X_{21}X_{22}X_{23}X_{24}X_8X_9CX_{10}X_{11}CX_{12}X_{13}X_{14}X_{15}X_{16}QSSNLVRH$ $X_{17}X_{18}X_{19}HX_{20}X_{21}X_{22}X_{23}X_{24}X_8X_9CX_{10}X_{11}CX_{12}X_{13}X_{14}X_{15}X_{16}RSDKLV$ $RHX_{17}X_{18}X_{19}HX_{20}X_{21}X_{22}X_{23}X_{24}X_8X_9CX_{10}X_{11}CX_{12}X_{13}X_{14}X_{15}X_{16}RSDD$ $LVRHX_{17}X_{18}X_{19}HX_{20}X_{21}X_{22}X_{23}X_{24}X_8X_9CX_{10}X_{11}CX_{12}X_{13}X_{14}X_{15}X_{16}TH$ $LDLIRHX_{17}X_{18}X_{19}HX_{20}X_{21}X_{22}X_{23}X_{24}X_{25}X_{26}X_{27}X_{28}X_{29}X_{30}$ | 2065 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| cggaaact gcgggggaa ctg | 968 | CGG GAA ACT GCG GGG GAA CTG | LEPGEKPYKCPECGKSFSRNDAL TEHQRTHTGEKPYKCPECGKSFS QSSNLVRHQRTHTGEKPYKCPEC GKSFSRSDKLVRHQRTHTGEKPY KCPECGKSFSRSDDLVRHQRTHT GEKPYKCPECGKSFSTHLDLIRH QRTHTGEKPYKCPECGKSFSQSS NLVRHQRTHTGEKPYKCPECGKS FSRSDKLTEHQRTHTGEKPTGKK TS | 1517 | $X_1X_2X_3X_4X_5X_6X_7X_8X_9CX_{10}X_{11}CX_{12}X_{13}X_{14}X_{15}X_{16}$RNDALTEH$X_{17}X_{18}X_{19}$ H$X_{20}X_{21}X_{22}X_{23}X_{24}X_8X_9$C$X_{10}X_{11}$C$X_{12}X_{13}X_{14}X_{15}X_{16}$QSSNLVRH$X_{17}X_{18}$ $X_{19}$H$X_{20}X_{21}X_{22}X_{23}X_{24}X_8X_9$C$X_{10}X_{11}$C$X_{12}X_{13}X_{14}X_{15}X_{16}$RSDKLVRH$X_{17}$ $X_{18}X_{19}$H$X_{20}X_{21}X_{22}X_{23}X_{24}X_8X_9$C$X_{10}X_{11}$C$X_{12}X_{13}X_{14}X_{15}X_{16}$RSDDLVRH $X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$THLDLI RH$X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$QSSN LVRH$X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$RS DKLTEH$X_{17}X_{18}X_{19}$H$X_{20}X_{21}X_{22}X_{23}X_{24}X_{25}X_{26}X_{27}X_{28}X_{29}X_{30}$ | 2066 |
| gaaactgcg gggggaactg gaa | 969 | GAA ACT GCG GGG GAA CTG GAA | LEPGEKPYKCPECGKSFSQSSNL VRHQRTHTGEKPYKCPECGKSFS RNDALTEHQRTHTGEKPYKCPEC GKSFSQSSNLVRHQRTHTGEKPY KCPECGKSFSRSDKLVRHQRTHT GEKPYKCPECGKSFSRSDDLVRH QRTHTGEKPYKCPECGKSFSTHL DLIRHQRTHTGEKPYKCPECGKS FSQSSNLVRHQRTHTGEKPTGKK TS | 1518 | $X_1X_2X_3X_4X_5X_6X_7X_8X_9CX_{10}X_{11}CX_{12}X_{13}X_{14}X_{15}X_{16}$QSSNLVRH$X_{17}X_{18}X_{19}$ H$X_{20}X_{21}X_{22}X_{23}X_{24}X_8X_9$C$X_{10}X_{11}$C$X_{12}X_{13}X_{14}X_{15}X_{16}$RNDALTEH$X_{17}X_{18}$ $X_{19}$H$X_{20}X_{21}X_{22}X_{23}X_{24}X_8X_9$C$X_{10}X_{11}$C$X_{12}X_{13}X_{14}X_{15}X_{16}$QSSNLVRH$X_{17}$ $X_{18}X_{19}$H$X_{20}X_{21}X_{22}X_{23}X_{24}X_8X_9$C$X_{10}X_{11}$C$X_{12}X_{13}X_{14}X_{15}X_{16}$RSDKLVRH $X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$RSDDLV RH$X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$THLD LIRH$X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$QS SNLVRH$X_{17}X_{18}X_{19}$H$X_{20}X_{21}X_{22}X_{23}X_{24}X_{25}X_{26}X_{27}X_{28}X_{29}X_{30}$ | 2067 |
| catctgggg cctgggatt tag | 970 | CAT CTG GGG CCT GGG ATT TAG | LEPGEKPYKCPECGKSFSREDNL HTHQRTHTGEKPYKCPECGKSFS HKNALQNHQRTHTGEKPYKCPEC GKSFSRSDKLVRHQRTHTGEKPY KCPECGKSFSTKNSLTEHQRTHT GEKPYKCPECGKSFSRSDKLVRH QRTHTGEKPYKCPECGKSFSRND ALTEHQRTHTGEKPYKCPECGKS FSTSGNLTEHQRTHTGEKPTGKK TS | 1519 | $X_1X_2X_3X_4X_5X_6X_7X_8X_9CX_{10}X_{11}CX_{12}X_{13}X_{14}X_{15}X_{16}$REDNLHTH$X_{17}X_{18}X_{19}$ H$X_{20}X_{21}X_{22}X_{23}X_{24}X_8X_9$C$X_{10}X_{11}$C$X_{12}X_{13}X_{14}X_{15}X_{16}$HKNALQNH$X_{17}X_{18}$ $X_{19}$H$X_{20}X_{21}X_{22}X_{23}X_{24}X_8X_9$C$X_{10}X_{11}$C$X_{12}X_{13}X_{14}X_{15}X_{16}$RSDKLVRH$X_{17}$ $X_{18}X_{19}$H$X_{20}X_{21}X_{22}X_{23}X_{24}X_8X_9$C$X_{10}X_{11}$C$X_{12}X_{13}X_{14}X_{15}X_{16}$TKNSLTEH $X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$RSDKLV RH$X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$RNDA LTEH$X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$TS GNLTEH$X_{17}X_{18}X_{19}$H$X_{20}X_{21}X_{22}X_{23}X_{24}X_{25}X_{26}X_{27}X_{28}X_{29}X_{30}$ | 2068 |
| gattggcat ctgggccct ggg | 971 | GAT TGG CAT CTG GGG CCT GGG | LEPGEKPYKCPECGKSFSRSDKL VRHQRTHTGEKPYKCPECGKSFS TKNSLTEHQRTHTGEKPYKCPEC GKSFSRSDKLVRHQRTHTGEKPY KCPECGKSFSRNDALTEHQRTHT GEKPYKCPECGKSFSTSGNLTEH QRTHTGEKPYKCPECGKSFSRSD HLTTHQRTHTGEKPYKCPECGKS FSTSGNLVRHQRTHTGEKPTGKK TS | 1520 | $X_1X_2X_3X_4X_5X_6X_7X_8X_9CX_{10}X_{11}CX_{12}X_{13}X_{14}X_{15}X_{16}$RSDKLVRH$X_{17}X_{18}X_{19}$ H$X_{20}X_{21}X_{22}X_{23}X_{24}X_8X_9$C$X_{10}X_{11}$C$X_{12}X_{13}X_{14}X_{15}X_{16}$TKNSLTEH$X_{17}X_{18}$ $X_{19}$H$X_{20}X_{21}X_{22}X_{23}X_{24}X_8X_9$C$X_{10}X_{11}$C$X_{12}X_{13}X_{14}X_{15}X_{16}$RSDKLVRH$X_{17}$ $X_{18}X_{19}$H$X_{20}X_{21}X_{22}X_{23}X_{24}X_8X_9$C$X_{10}X_{11}$C$X_{12}X_{13}X_{14}X_{15}X_{16}$RNDALTEH $X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$TSGNLT EH$X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$RSDH LTTH$X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$TS GNLVRH$X_{17}X_{18}X_{19}$H$X_{20}X_{21}X_{22}X_{23}X_{24}X_{25}X_{26}X_{27}X_{28}X_{29}X_{30}$ | 2069 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| tggcatctg gggcctggg att | 972 | TGG CAT CTG ggg CCT ggg ATT | LEPGEKPYKCPECGKSFSHKNAL QNHQRTHTGEKPYKCPECGKSFS RSDKLVRHQRTHTGEKPYKCPEC GKSFSTKNSLTEHQRTHTGEKPY KCPECGKSFSRSDKLVRHQRTHT GEKPYKCPECGKSFSRNDALTEH QRTHTGEKPYKCPECGKSFSTSG NLTEHQRTHTGEKPYKCPECGKS FSRSDHLTTHQRTHTGEKPTGKK TS | 1521 | $X_1X_2X_3X_4X_5X_6X_7X_8X_9CX_{10}X_{11}CX_{12}X_{13}X_{14}X_{15}X_{16}$HKNALQNH$X_{17}X_{18}X_{19}$H$X_{20}X_{21}X_{22}X_{23}X_{24}X_{8}X_{9}$C$X_{10}X_{11}$C$X_{12}X_{13}X_{14}X_{15}X_{16}$RSDKLVRH$X_{17}X_{18}$$X_{19}$H$X_{20}X_{21}X_{22}X_{23}X_{24}X_{8}X_{9}$C$X_{10}X_{11}$C$X_{12}X_{13}X_{14}X_{15}X_{16}$TKNSLTEH$X_{17}$$X_{18}X_{19}$H$X_{20}X_{21}X_{22}X_{23}X_{24}X_{8}X_{9}$C$X_{10}X_{11}$C$X_{12}X_{13}X_{14}X_{15}X_{16}$RSDKLVRH $X_{17}X_{18}X_{19}$H$X_{20}X_{21}X_{22}X_{23}X_{24}X_{8}X_{9}$C$X_{10}X_{11}$C$X_{12}X_{13}X_{14}X_{15}X_{16}$RNDALT EH$X_{17}X_{18}X_{19}$H$X_{20}X_{21}X_{22}X_{23}X_{24}X_{8}X_{9}$C$X_{10}X_{11}$C$X_{12}X_{13}X_{14}X_{15}X_{16}$TSGN LTEH$X_{17}X_{18}X_{19}$H$X_{20}X_{21}X_{22}X_{23}X_{24}X_{8}X_{9}$C$X_{10}X_{11}$C$X_{12}X_{13}X_{14}X_{15}X_{16}$RS DHLTTH$X_{17}X_{18}X_{19}$H$X_{20}X_{21}X_{22}X_{23}X_{24}X_{25}X_{26}X_{27}X_{28}X_{29}X_{30}$ | 2070 |
| cagaacaag gatccagaa gat | 973 | CAG AAC AAG GAT CCA GAA GAT | LEPGEKPYKCPECGKSFSTSGNL VRHQRTHTGEKPYKCPECGKSFS QSSNLVRHQRTHTGEKPYKCPEC GKSFSTSHSLTEHQRTHTGEKPY KCPECGKSFSTSGNLVRHQRTHT GEKPYKCPECGKSFSRKDNLKNH QRTHTGEKPYKCPECGKSFSDSG NLRVHQRTHTGEKPYKCPECGKS FSRADNLTEHQRTHTGEKPTGKK TS | 1522 | $X_1X_2X_3X_4X_5X_6X_7X_8X_9$C$X_{10}X_{11}$C$X_{12}X_{13}X_{14}X_{15}X_{16}$TSGNLVRH$X_{17}X_{18}X_{19}$H$X_{20}X_{21}X_{22}X_{23}X_{24}X_{8}X_{9}$C$X_{10}X_{11}$C$X_{12}X_{13}X_{14}X_{15}X_{16}$QSSNLVRH$X_{17}X_{18}$ $X_{19}$H$X_{20}X_{21}X_{22}X_{23}X_{24}X_{8}X_{9}$C$X_{10}X_{11}$C$X_{12}X_{13}X_{14}X_{15}X_{16}$TSHSLTEH$X_{17}$ $X_{18}X_{19}$H$X_{20}X_{21}X_{22}X_{23}X_{24}X_{8}X_{9}$C$X_{10}X_{11}$C$X_{12}X_{13}X_{14}X_{15}X_{16}$TSGNLVRH $X_{17}X_{18}X_{19}$H$X_{20}X_{21}X_{22}X_{23}X_{24}X_{8}X_{9}$C$X_{10}X_{11}$C$X_{12}X_{13}X_{14}X_{15}X_{16}$RKDNLK NH$X_{17}X_{18}X_{19}$H$X_{20}X_{21}X_{22}X_{23}X_{24}X_{8}X_{9}$C$X_{10}X_{11}$C$X_{12}X_{13}X_{14}X_{15}X_{16}$DSGN LRVH$X_{17}X_{18}X_{19}$H$X_{20}X_{21}X_{22}X_{23}X_{24}X_{8}X_{9}$C$X_{10}X_{11}$C$X_{12}X_{13}X_{14}X_{15}X_{16}$RA DNLTEH$X_{17}X_{18}X_{19}$H$X_{20}X_{21}X_{22}X_{23}X_{24}X_{25}X_{26}X_{27}X_{28}X_{29}X_{30}$ | 2071 |
| gaagattgg catctgggg cct | 974 | GAA GAT TGG CAT CTG ggg CCT | LEPGEKPYKCPECGKSFSTKNSL TEHQRTHTGEKPYKCPECGKSFS RSDKLVRHQRTHTGEKPYKCPEC GKSFSRNDALTEHQRTHTGEKPY KCPECGKSFSTSGNLTEHQRTHT GEKPYKCPECGKSFSRSDHLTTH QRTHTGEKPYKCPECGKSFSTSG NLVRHQRTHTGEKPYKCPECGKS FSQSSNLVRHQRTHTGEKPTGKK TS | 1523 | $X_1X_2X_3X_4X_5X_6X_7X_8X_9$C$X_{10}X_{11}$C$X_{12}X_{13}X_{14}X_{15}X_{16}$TKNSLTEH$X_{17}X_{18}X_{19}$ H$X_{20}X_{21}X_{22}X_{23}X_{24}X_{8}X_{9}$C$X_{10}X_{11}$C$X_{12}X_{13}X_{14}X_{15}X_{16}$RSDKLVRH$X_{17}X_{18}$ $X_{19}$H$X_{20}X_{21}X_{22}X_{23}X_{24}X_{8}X_{9}$C$X_{10}X_{11}$C$X_{12}X_{13}X_{14}X_{15}X_{16}$RNDALTEH$X_{17}$ $X_{18}X_{19}$H$X_{20}X_{21}X_{22}X_{23}X_{24}X_{8}X_{9}$C$X_{10}X_{11}$C$X_{12}X_{13}X_{14}X_{15}X_{16}$TSGNLTEH $X_{17}X_{18}X_{19}$H$X_{20}X_{21}X_{22}X_{23}X_{24}X_{8}X_{9}$C$X_{10}X_{11}$C$X_{12}X_{13}X_{14}X_{15}X_{16}$RSDHLT TH$X_{17}X_{18}X_{19}$H$X_{20}X_{21}X_{22}X_{23}X_{24}X_{8}X_{9}$C$X_{10}X_{11}$C$X_{12}X_{13}X_{14}X_{15}X_{16}$TSGN LVRH$X_{17}X_{18}X_{19}$H$X_{20}X_{21}X_{22}X_{23}X_{24}X_{8}X_{9}$C$X_{10}X_{11}$C$X_{12}X_{13}X_{14}X_{15}X_{16}$QS SNLVRH$X_{17}X_{18}X_{19}$H$X_{20}X_{21}X_{22}X_{23}X_{24}X_{25}X_{26}X_{27}X_{28}X_{29}X_{30}$ | 2072 |
| aacaaggat ccagaagat tgg | 975 | AAC AAG GAT CCA GAA GAT TGG | LEPGEKPYKCPECGKSFSRSDHL TTHQRTHTGEKPYKCPECGKSFS TSGNLVRHQRTHTGEKPYKCPEC GKSFSQSSNLVRHQRTHTGEKPY KCPECGKSFSTSHSLTEHQRTHT GEKPYKCPECGKSFSTSGNLVRH QRTHTGEKPYKCPECGKSFSRKD NLKNHQRTHTGEKPYKCPECGKS FSDSGNLRVHQRTHTGEKPTGKK TS | 1524 | $X_1X_2X_3X_4X_5X_6X_7X_8X_9$C$X_{10}X_{11}$C$X_{12}X_{13}X_{14}X_{15}X_{16}$RSDHLTTH$X_{17}X_{18}X_{19}$ H$X_{20}X_{21}X_{22}X_{23}X_{24}X_{8}X_{9}$C$X_{10}X_{11}$C$X_{12}X_{13}X_{14}X_{15}X_{16}$TSGNLVRH$X_{17}X_{18}$ $X_{19}$H$X_{20}X_{21}X_{22}X_{23}X_{24}X_{8}X_{9}$C$X_{10}X_{11}$C$X_{12}X_{13}X_{14}X_{15}X_{16}$QSSNLVRH$X_{17}$ $X_{18}X_{19}$H$X_{20}X_{21}X_{22}X_{23}X_{24}X_{8}X_{9}$C$X_{10}X_{11}$C$X_{12}X_{13}X_{14}X_{15}X_{16}$TSHSLTEH $X_{17}X_{18}X_{19}$H$X_{20}X_{21}X_{22}X_{23}X_{24}X_{8}X_{9}$C$X_{10}X_{11}$C$X_{12}X_{13}X_{14}X_{15}X_{16}$TSGNLV RH$X_{17}X_{18}X_{19}$H$X_{20}X_{21}X_{22}X_{23}X_{24}X_{8}X_{9}$C$X_{10}X_{11}$C$X_{12}X_{13}X_{14}X_{15}X_{16}$RKDN LKNH$X_{17}X_{18}X_{19}$H$X_{20}X_{21}X_{22}X_{23}X_{24}X_{8}X_{9}$C$X_{10}X_{11}$C$X_{12}X_{13}X_{14}X_{15}X_{16}$DS GNLRVH$X_{17}X_{18}X_{19}$H$X_{20}X_{21}X_{22}X_{23}X_{24}X_{25}X_{26}X_{27}X_{28}X_{29}X_{30}$ | 2073 |

TABLE 10-continued

| Column 1 Nucleotide Sequence of Target Site in HNF4α Expression Control Region | Column 2 Target sequence with space | Column 3 SEQ ID NO. (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| ccagaagat tggcatctg ggg | CCA GAA GAT TGG CAT CTG GGG | 976 | LEPGEKPYKCPECGKSFSRSDKL VRHQRTHTGEKPYKCPECGKSFS RNDALTEHQRTHTGEKPYKCPEC GKSFSTSGNLTEHQRTHTGEKPY KCPECGKSFSRSDHLTTHQRTHT GEKPYKCPECGKSFSTSGNLVRH QRTHTGEKPYKCPECGKSFSQSS NLVRHQRTHTGEKPYKCPECGKS FSTSHSLTEHQRTHTGEKPTGKK TS | 1525 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}HX_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTH X_{17}X_{18}X_{19}HX_{20}X_{21}X_{22}X_{23}X_{24}X_8X_9CX_{10}X_{11}CX_{12}X_{13}X_{14}X_{15}X_{16}TSGNLV RHX_{17}X_{18}X_{19}HX_{20}X_{21}X_{22}X_{23}X_{24}X_8X_9CX_{10}X_{11}CX_{12}X_{13}X_{14}X_{15}X_{16}QSSN LVRHX_{17}X_{18}X_{19}HX_{20}X_{21}X_{22}X_{23}X_{24}X_8X_9CX_{10}X_{11}CX_{12}X_{13}X_{14}X_{15}X_{16}TS HSLTEHX_{17}X_{18}X_{19}HX_{20}X_{21}X_{22}X_{23}X_{24}X_{25}X_{26}X_{27}X_{28}X_{29}X_{30}$ | 2074 |
| gatccagaa gatggcat ctg | GAT CCA GAA GAT TGG CAT CTG | 977 | LEPGEKPYKCPECGKSFSRNDAL TEHQRTHTGEKPYKCPECGKSFS TSGNLTEHQRTHTGEKPYKCPEC GKSFSRSDHLTTHQRTHTGEKPY KCPECGKSFSTSGNLVRHQRTHT GEKPYKCPECGKSFSQSSNLVRH QRTHTGEKPYKCPECGKSFSTSH SLTEHQRTHTGEKPYKCPECGKS FSTSGNLVRHQRTHTGEKPTGKK TS | 1526 | $X_1X_2X_3X_4X_5X_6X_7X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLV RHX_{17}X_{18}X_{19}HX_{20}X_{21}X_{22}X_{23}X_{24}X_8X_9CX_{10}X_{11}CX_{12}X_{13}X_{14}X_{15}X_{16}QSSNLV RHX_{17}X_{18}X_{19}HX_{20}X_{21}X_{22}X_{23}X_{24}X_8X_9CX_{10}X_{11}CX_{12}X_{13}X_{14}X_{15}X_{16}TSHS LTEHX_{17}X_{18}X_{19}HX_{20}X_{21}X_{22}X_{23}X_{24}X_8X_9CX_{10}X_{11}CX_{12}X_{13}X_{14}X_{15}X_{16}TS GNLVRHX_{17}X_{18}X_{19}HX_{20}X_{21}X_{22}X_{23}X_{24}X_{25}X_{26}X_{27}X_{28}X_{29}X_{30}$ | 2075 |
| aaggatcca gaagattgg cat | AAG GAT CCA GAA GAT TGG CAT | 978 | LEPGEKPYKCPECGKSFSTSGNL TEHQRTHTGEKPYKCPECGKSFS RSDHLTTHQRTHTGEKPYKCPEC GKSFSTSGNLVRHQRTHTGEKPY KCPECGKSFSQSSNLVRHQRTHT GEKPYKCPECGKSFSTSHSLTEH QRTHTGEKPYKCPECGKSFSTSG NLVRHQRTHTGEKPYKCPECGKS FSRKDNLKNHQRTHTGEKPTGKK TS | 1527 | $X_1X_2X_3X_4X_5X_6X_7X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSSNLVRH X_{17}X_{18}X_{19}HX_{20}X_{21}X_{22}X_{23}X_{24}X_8X_9CX_{10}X_{11}CX_{12}X_{13}X_{14}X_{15}X_{16}TSHSLT EHX_{17}X_{18}X_{19}HX_{20}X_{21}X_{22}X_{23}X_{24}X_8X_9CX_{10}X_{11}CX_{12}X_{13}X_{14}X_{15}X_{16}TSGN LVRHX_{17}X_{18}X_{19}HX_{20}X_{21}X_{22}X_{23}X_{24}X_8X_9CX_{10}X_{11}CX_{12}XEX_{14}X_{15}X_{16}RK DNLKNHX_{17}X_{18}X_{19}HX_{20}X_{21}X_{22}X_{23}X_{24}X_{25}X_{26}X_{27}X_{28}X_{29}X_{30}$ | 2076 |
| ctggggcct gggattag gtt | CTG ggg CCT GGG ATT TAG GTT | 979 | LEPGEKPYKCPECGKSFSTSGSL VRHQRTHTGEKPYKCPECGKSFS REDNLHTHQRTHTGEKPYKCPEC GKSFSHKNALQNHQRTHTGEKPY KCPECGKSFSRSDKLVRHQRTHT GEKPYKCPECGKSFSTKNSLTEH QRTHTGEKPYKCPECGKSFSRSD KLVRHQRTHTGEKPYKCPECGKS FSRNDALTEHQRTHTGEKPTGKK TS | 1528 | $X_1X_2X_3X_4X_5X_6X_7X_8X_9CX_{10}X_{11}CX_{12}X_{13}X_{14}X_{15}X_{16}TSGSLVRHX_{17}X_{18}X_{19}HX_{20}X_{21}X_{22}X_{23}X_{24}X_8X_9CX_{10}X_{11}CX_{12}X_{13}X_{14}X_{15}X_{16}REDNLHTHX_{17}X_{18}X_{19}HX_{20}X_{21}X_{22}X_{23}X_{24}X_8X_9CX_{10}X_{11}CX_{12}X_{13}X_{14}X_{15}X_{16}HKNALQNHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRH X_{17}X_{18}X_{19}HX_{20}X_{21}X_{22}X_{23}X_{24}X_8X_9CX_{10}X_{11}CX_{12}X_{13}X_{14}X_{15}X_{16}TKNSLT EHX_{17}X_{18}X_{19}HX_{20}X_{21}X_{22}X_{23}X_{24}X_8X_9CX_{10}X_{11}CX_{12}X_{13}X_{14}X_{15}X_{16}RSDK LVRHX_{17}X_{18}X_{19}HX_{20}X_{21}X_{22}X_{23}X_{24}X_8X_9CX_{10}X_{11}CX_{12}X_{13}X_{14}X_{15}X_{16}RN DALTEHX_{17}X_{18}X_{19}HX_{20}X_{21}X_{22}X_{23}X_{24}X_{25}X_{26}X_{27}X_{28}X_{29}X_{30}$ | 2077 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| ctaaatcgt gggcatgg ggc | 980 | CTA AAT CGT ggg CCA TGG GGC | LEPGEKPYKCPECGKSFSDPGHL VRHQRTHTGEKPYKCPECGKSFS RSDHLTTHQRTHTGEKPYKCPEC GKSFSTSHSLTEHQRTHTGEKPY KCPECGKSFSRSDKLVRHQRTHT GEKPYKCPECGKSFSRRTCRAH QRTHTGEKPYKCPECGKSFSTTG NLTVHQRTHTGEKPYKCPECGKS FSQNSTLTEHQRTHTGEKPTGKK TS | 1529 | $X_1X_2X_3X_4X_5X_6X_7X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}SRRTCRAHX_{17}X_{18}X_{19}HX_{20}X_{21}X_{22}X_{23}X_{24}X_8X_9CX_{10}X_{11}CX_{12}X_{13}X_{14}X_{15}X_{16}TTGNLTVHX_{17}X_{18}X_{19}HX_{20}X_{21}X_{22}X_{23}X_{24}X_8X_9CX_{10}X_{11}CX_{12}X_{13}X_{14}X_{15}X_{16}QNSTLTEHX_{17}X_{18}X_{19}HX_{20}X_{21}X_{22}X_{23}X_{24}X_{25}X_{26}X_{27}X_{28}X_{29}X_{30}$ | 2078 |
| aatcgtggg ccatgggc agc | 981 | AAT CGT ggg CCA TGG GGC AGC | LEPGEKPYKCPECGKSFSERSHL REHQRTHTGEKPYKCPECGKSFS DPGHLVRHQRTHTGEKPYKCPEC GKSFSRSDHLTTHQRTHTGEKPY KCPECGKSFSTSHSLTEHQRTHT GEKPYKCPECGKSFSRSDKLVRH QRTHTGEKPYKCPECGKSFSSRR TCRAHQRTHTGEKPYKCPECGKS FSTTGNLTVHQRTHTGEKPTGKK TS | 1530 | $X_1X_2X_3X_4X_5X_6X_7X_8X_9CX_{10}X_{11}CX_{12}X_{13}X_{14}X_{15}X_{16}ERSHLREHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}SRRTCRAHX_{17}X_{18}X_{19}HX_{20}X_{21}X_{22}X_{23}X_{24}X_8X_9CX_{10}X_{11}CX_{12}X_{13}X_{14}X_{15}X_{16}TTGNLTVHX_{17}X_{18}X_{19}HX_{20}X_{21}X_{22}X_{23}X_{24}X_{25}X_{26}X_{27}X_{28}X_{29}X_{30}$ | 2079 |
| cgtgggcca tggggcagc ctt | 982 | CGT ggg CCA TGG GGC AGC CTT | LEPGEKPYKCPECGKSFSTTGAL TEHQRTHTGEKPYKCPECGKSFS ERSHLREHQRTHTGEKPYKCPEC GKSFSDPGHLVRHQRTHTGEKPY KCPECGKSFSRSDHLTTHQRTHT GEKPYKCPECGKSFSTSHSLTEH QRTHTGEKPYKCPECGKSFSRSD KLVRHQRTHTGEKPYKCPECGKS FSSRRTCRAHQRTHTGEKPTGKK TS | 1531 | $X_1X_2X_3X_4X_5X_6X_7X_8X_9CX_{10}X_{11}CX_{12}X_{13}X_{14}X_{15}X_{16}TTGALTEHX_{17}X_{18}X_{19}HX_{20}X_{21}X_{22}X_{23}X_{24}X_8X_9CX_{10}X_{11}CX_{12}X_{13}X_{14}X_{15}X_{16}ERSHLREHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}XEX_{14}X_{15}X_{16}SRRTCRAHX_{17}X_{18}X_{19}HX_{20}X_{21}X_{22}X_{23}X_{24}X_{25}X_{26}X_{27}X_{28}X_{29}X_{30}$ | 2080 |
| ctgcaaaag cattgaggg tag | 983 | CTG CAA AAG CAT TGA GGG TAG | LEPGEKPYKCPECGKSFSREDNL HTHQRTHTGEKPYKCPECGKSFS RSDKLVRHQRTHTGEKPYKCPEC GKSFSQAGHLASHQRTHTGEKPY KCPECGKSFSTSGNLTEHQRTHT GEKPYKCPECGKSFSRKDNLKNH QRTHTGEKPYKCPECGKSFSQSG NLTEHQRTHTGEKPYKCPECGKS FSRNDALTEHQRTHTGEKPTGKK TS | 152 | $X_1X_2X_3X_4X_5X_6X_7X_8X_9CX_{10}X_{11}CX_{12}X_{13}X_{14}X_{15}X_{16}REDNLHTHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QAGHLASHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}RKDNLKNHX_{17}X_{18}X_{19}HX_{20}X_{21}X_{22}X_{23}X_{24}X_8X_9CX_{10}X_{11}CX_{12}X_{13}X_{14}X_{15}X_{16}QSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_{25}X_{26}X_{27}X_{28}X_{29}X_{30}$ | 2081 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| caaaagcat tgagggtag aag | 984 | CAA AAG CAT TGA GGG TAG APG | LEPGEKPYKCPECGKSFSRKDNL KNHQRTHTGEKPYKCPECGKSFS REDNLHTHQRTHTGEKPYKCPEC GKSFSRSDKLVRHQRTHTGEKPY KCPECGKSFSQAGHLASHQRTHT GEKPYKCPECGKSFSTSGNLTEH QRTHTGEKPYKCPECGKSFSRKD NLKNHQRTHTGEKPYKCPECGKS FSQSGNLTEHQRTHTGEKPTGKK TS | 1533 | $X_1X_2X_3X_4X_5X_6X_7X_8X_9CX_{10}X_{11}CX_{12}X_{13}X_{14}X_{15}X_{16}$RKDNLKNH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$REDNLHTH$X_{17}X_{18}$ $X_{19}HX_{20}X_{21}X_{22}X_{23}X_{24}X_8X_9CX_{10}X_{11}CX_{12}X_{13}X_{14}X_{15}X_{16}$RSDKLVRH$X_{17}$ $X_{18}X_{19}HX_{20}X_{21}X_{22}X_{23}X_{24}X_8X_9CX_{10}X_{11}CX_{12}X_{13}X_{14}X_{15}X_{16}$QAGHLASH $X_{17}X_{18}X_{19}HX_{20}X_{21}X_{22}X_{23}X_{24}X_8X_9CX_{10}X_{11}CX_{12}X_{13}X_{14}X_{15}X_{16}$TSGNLT EH$X_{17}X_{18}X_{19}HX_{20}X_{21}X_{22}X_{23}X_{24}X_8X_9CX_{10}X_{11}CX_{12}X_{13}X_{14}X_{15}X_{16}$RKDN LKNH$X_{17}X_{18}X_{19}HX_{20}X_{21}X_{22}X_{23}X_{24}X_8X_9CX_{10}X_{11}CX_{12}X_{13}X_{14}X_{15}X_{16}$QS GNLTEH$X_{17}X_{18}X_{19}HX_{20}X_{21}X_{22}X_{23}X_{24}X_{25}X_{26}X_{27}X_{28}X_{29}X_{30}$ | 2082 |
| aaaagcatt gagggtaga agt | 985 | AAA AGC ATT GAG GGT AGA AGT | LEPGEKPYKCPECGKSFSHRTTL TNHQRTHTGEKPYKCPECGKSFS QLAHLRAHQRTHTGEKPYKCPEC GKSFSTSGHLVRHQRTHTGEKPY KCPECGKSFSRSDNLVRHQRTHT GEKPYKCPECGKSFSHKNALQNH QRTHTGEKPYKCPECGKSFSERS HLREHQRTHTGEKPYKCPECGKS FSQRANLRAHQRTHTGEKPTGKK TS | 1534 | $X_1X_2X_3X_4X_5X_6X_7X_8X_9CX_{10}X_{11}CX_{12}X_{13}X_{14}X_{15}X_{16}$HRTTLTNH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$QLAHLRAH$X_{17}X_{18}$ $X_{19}HX_{20}X_{21}X_{22}X_{23}X_{24}X_8X_9CX_{10}X_{11}CX_{12}X_{13}X_{14}X_{15}X_{16}$TSGHLVRH$X_{17}$ $X_{18}X_{19}HX_{20}X_{21}X_{22}X_{23}X_{24}X_8X_9CX_{10}X_{11}CX_{12}X_{13}X_{14}X_{15}X_{16}$RSDNLVRH $X_{17}X_{18}X_{19}HX_{20}X_{21}X_{22}X_{23}X_{24}X_8X_9CX_{10}X_{11}CX_{12}X_{13}X_{14}X_{15}X_{16}$HKNALQ NH$X_{17}X_{18}X_{19}HX_{20}X_{21}X_{22}X_{23}X_{24}X_8X_9CX_{10}X_{11}CX_{12}X_{13}X_{14}X_{15}X_{16}$ERSH LREH$X_{17}X_{18}X_{19}HX_{20}X_{21}X_{22}X_{23}X_{24}X_8X_9CX_{10}X_{11}CX_{12}X_{13}X_{14}X_{15}X_{16}$QR ANLRAH$X_{17}X_{18}X_{19}HX_{20}X_{21}X_{22}X_{23}X_{24}X_{25}X_{26}X_{27}X_{28}X_{29}X_{30}$ | 2083 |
| attgagggt agagtcaa tga | 986 | ATT GAG GGT AGA GTC AAT GA | LEPGEKPYKCPECGKSFSQAGHL ASHQRTHTGEKPYKCPECGKSFS QSGNLTEHQRTHTGEKPYKCPEC GKSFSHRTTLTNHQRTHTGEKPY KCPECGKSFSQLAHLRAHQRTHT GEKPYKCPECGKSFSTSGHLVRH QRTHTGEKPYKCPECGKSFSRSD NLVRHQRTHTGEKPYKCPECGKS FSHKNALQNHQRTHTGEKPTGKK TS | 1535 | $X_1X_2X_3X_4X_5X_6X_7X_8X_9CX_{10}X_{11}CX_{12}X_{13}X_{14}X_{15}X_{16}$QAGHLASH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$QSGNLTEH$X_{17}X_{18}$ $X_{19}HX_{20}X_{21}X_{22}X_{23}X_{24}X_8X_9CX_{10}X_{11}CX_{12}X_{13}X_{14}X_{15}X_{16}$HRTTLTNH$X_{17}$ $X_{18}X_{19}HX_{20}X_{21}X_{22}X_{23}X_{24}X_8X_9CX_{10}X_{11}CX_{12}X_{13}X_{14}X_{15}X_{16}$QLAHLRAH $X_{17}X_{18}X_{19}HX_{20}X_{21}X_{22}X_{23}X_{24}X_8X_9CX_{10}X_{11}CX_{12}X_{13}X_{14}X_{15}X_{16}$TSGHLV RH$X_{17}X_{18}X_{19}HX_{20}X_{21}X_{22}X_{23}X_{24}X_8X_9CX_{10}X_{11}CX_{12}X_{13}X_{14}X_{15}X_{16}$RSDN LVRH$X_{17}X_{18}X_{19}HX_{20}X_{21}X_{22}X_{23}X_{24}X_8X_9CX_{10}X_{11}CX_{12}X_{13}X_{14}X_{15}X_{16}$HK NALQNH$X_{17}X_{18}X_{19}HX_{20}X_{21}X_{22}X_{23}X_{24}X_{25}X_{26}X_{27}X_{28}X_{29}X_{30}$ | 2084 |
| agcattgag ggtagaagt caa | 987 | AGC ATT GAG GGT AGA AGT CAA | LEPGEKPYKCPECGKSFSQSGNL TEHQRTHTGEKPYKCPECGKSFS HRTTLTNHQRTHTGEKPYKCPEC GKSFSQLAHLRAHQRTHTGEKPY KCPECGKSFSTSGHLVRHQRTHT GEKPYKCPECGKSFSRSDNLVRH QRTHTGEKPYKCPECGKSFSHKN ALQNHQRTHTGEKPYKCPECGKS FSERSHLREHQRTHTGEKPTGKK TS | 1536 | $X_1X_2X_3X_4X_5X_6X_7X_8X_9CX_{10}X_{11}CX_{12}X_{13}X_{14}X_{15}X_{16}$QSGNLTEH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$HRTTLTNH$X_{17}X_{18}$ $X_{19}HX_{20}X_{21}X_{22}X_{23}X_{24}X_8X_9CX_{10}X_{11}CX_{12}X_{13}X_{14}X_{15}X_{16}$QLAHLRAH$X_{17}$ $X_{18}X_{19}HX_{20}X_{21}X_{22}X_{23}X_{24}X_8X_9CX_{10}X_{11}CX_{12}X_{13}X_{14}X_{15}X_{16}$TSGHLVRH $X_{17}X_{18}X_{19}HX_{20}X_{21}X_{22}X_{23}X_{24}X_8X_9CX_{10}X_{11}CX_{12}X_{13}X_{14}X_{15}X_{16}$RSDNLV RH$X_{17}X_{18}X_{19}HX_{20}X_{21}X_{22}X_{23}X_{24}X_8X_9CX_{10}X_{11}CX_{12}X_{13}X_{14}X_{15}X_{16}$HKNA LQNH$X_{17}X_{18}X_{19}HX_{20}X_{21}X_{22}X_{23}X_{24}X_8X_9CX_{10}X_{11}CX_{12}X_{13}X_{14}X_{15}X_{16}$ER SHLREH$X_{17}X_{18}X_{19}HX_{20}X_{21}X_{22}X_{23}X_{24}X_{25}X_{26}X_{27}X_{28}X_{29}X_{30}$ | 2085 |

TABLE 10-continued

| Column 1 Nucleotide Sequence of Target Site in HNF4α Expression Control Region | Column 2 Target sequence with space | Column 3 Target sequence | Column 4 SEQ ID NO. (corresponds to sequences in Columns 1 and 3) | Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|---|
| atgatttgg aagtgtatt gaa | ATG ATT TGG GAA GTT ATT GAA | | 988 | LEPGEKPYKCPECGKSFSQSSNL VRHQRTHTGEKPYKCPECGKSFS HKNALQNHQRTHTGEKPYKCPEC GKSFSTSGSLVRHQRTHTGEKPY KCPECGKSFSQSSNLVRHQRTHT GEKPYKCPECGKSFSRSDHLTTH QRTHTGEKPYKCPECGKSFSHKN ALQNHQRTHTGEKPYKCPECGKS FSRRDELNVHQRTHTGEKPTGKK TS | 1537 | $X_1X_2X_3X_4X_5X_6X_7X_8X_9CX_{10}X_{11}CX_{12}X_{13}X_{14}X_{15}X_{16}QSSNLVRHX_{17}X_{18}X_{19}HX_{20}X_{21}X_{22}X_{23}X_{24}X_8X_9CX_{10}X_{11}CX_{12}X_{13}X_{14}X_{15}X_{16}HKNALQNHX_{17}X_{18}X_{19}HX_{20}X_{21}X_{22}X_{23}X_{24}X_8X_9CX_{10}X_{11}CX_{12}X_{13}X_{14}X_{15}X_{16}TSGSLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSSNLVRH X_{17}X_{18}X_{19}HX_{20}X_{21}X_{22}X_{23}X_{24}X_8X_9CX_{10}X_{11}CX_{12}X_{13}X_{14}X_{15}X_{16}RSDHLT THX_{17}X_{18}X_{19}HX_{20}X_{21}X_{22}X_{23}X_{24}X_8X_9CX_{10}X_{11}CX_{12}X_{13}X_{14}X_{15}X_{16}HKNA LQNHX_{17}X_{18}X_{19}HX_{20}X_{21}X_{22}X_{23}X_{24}X_8X_9CX_{10}X_{11}CX_{12}X_{13}X_{14}X_{15}X_{16}RR DELNVHX_{17}X_{18}X_{19}HX_{20}X_{21}X_{22}X_{23}X_{24}X_{25}X_{26}X_{27}X_{28}X_{29}X_{30}$ | 2086 |
| taggctgtc agtgcctga tag | TAG GCT GTC AGT GCC TGA TAG | | 989 | LEPGEKPYKCPECGKSFSREDNL HTHQRTHTGEKPYKCPECGKSFS QAGHLASHQRTHTGEKPYKCPEC GKSFSDCRDLARHQRTHTGEKPY KCPECGKSFSHRTTLTNHQRTHT GEKPYKCPECGKSFSDPGALVRH QRTHTGEKPYKCPECGKSFSTSG ELVRHQRTHTGEKPYKCPECGKS FSREDNLHTHQRTHTGEKPTGKK TS | 1538 | $X_1X_2X_3X_4X_5X_6X_7X_8X_9CX_{10}X_{11}CX_{12}X_{13}X_{14}X_{15}X_{16}REDNLHTHX_{17}X_{18}X_{19}HX_{20}X_{21}X_{22}X_{23}X_{24}X_8X_9CX_{10}X_{11}CX_{12}X_{13}X_{14}X_{15}X_{16}QAGHLASHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}HRTTLTNH X_{17}X_{18}X_{19}HX_{20}X_{21}X_{22}X_{23}X_{24}X_8X_9CX_{10}X_{11}CX_{12}X_{13}X_{14}X_{15}X_{16}DPGALV RHX_{17}X_{18}X_{19}HX_{20}X_{21}X_{22}X_{23}X_{24}X_8X_9CX_{10}X_{11}CX_{12}X_{13}X_{14}X_{15}X_{16}TSGE LVRHX_{17}X_{18}X_{19}HX_{20}X_{21}X_{22}X_{23}X_{24}X_8X_9CX_{10}X_{11}CX_{12}XEX_{14}X_{15}X_{16}RE DNLHTHX_{17}X_{18}X_{19}HX_{20}X_{21}X_{22}X_{23}X_{24}X_{25}X_{26}X_{27}X_{28}X_{29}X_{30}$ | 2087 |
| aggtaggct gctgtagcc tga | AGG TAG GCT GCT GTA GCC TGA | | 990 | LEPGEKPYKCPECGKSFSQAGHL ASHQRTHTGEKPYKCPECGKSFS DCRDLARHQRTHTGEKPYKCPEC GKSFSHRTTLTNHQRTHTGEKPY KCPECGKSFSDPGALVRHQRTHT GEKPYKCPECGKSFSTSGELVRH QRTHTGEKPYKCPECGKSFSRED NLHTHQRTHTGEKPYKCPECGKS FSRSDHLTNHQRTHTGEKPTGKK TS | 1539 | $X_1X_2X_3X_4X_5X_6X_7X_8X_9CX_{10}X_{11}CX_{12}X_{13}X_{14}X_{15}X_{16}QAGHLASHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}HRTTLTNHX_{17}X_{18}X_{19}HX_{20}X_{21}X_{22}X_{23}X_{24}X_8X_9CX_{10}X_{11}CX_{12}X_{13}X_{14}X_{15}X_{16}DPGALVRH X_{17}X_{18}X_{19}HX_{20}X_{21}X_{22}X_{23}X_{24}X_8X_9CX_{10}X_{11}CX_{12}X_{13}X_{14}X_{15}X_{16}TSGELV RHX_{17}X_{18}X_{19}HX_{20}X_{21}X_{22}X_{23}X_{24}X_8X_9CX_{10}X_{11}CX_{12}X_{13}X_{14}X_{15}X_{16}REDN LHTHX_{17}X_{18}X_{19}HX_{20}X_{21}X_{22}X_{23}X_{24}X_8X_9CX_{10}X_{11}CX_{12}X_{13}X_{14}X_{15}X_{16}RS DHLTNHX_{17}X_{18}X_{19}HX_{20}X_{21}X_{22}X_{23}X_{24}X_{25}X_{26}X_{27}X_{28}X_{29}X_{30}$ | 2088 |
| cggaggtag gctgtcagt gcc | CGG AGG TAG GCT GTC AGT GCC | | 991 | LEPGEKPYKCPECGKSFSDCRDL ARHQRTHTGEKPYKCPECGKSFS HRTTLTNHQRTHTGEKPYKCPEC GKSFSDPGALVRHQRTHTGEKPY KCPECGKSFSTSGELVRHQRTHT GEKPYKCPECGKSFSREDNLHTH QRTHTGEKPYKCPECGKSFSRSD HLTNHQRTHTGEKPYKCPECGKS FSRSDKLTEHQRTHTGEKPTGKK TS | 1540 | $X_1X_2X_3X_4X_5X_6X_7X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}HRTTLTNHX_{17}X_{18}X_{19}HX_{20}X_{21}X_{22}X_{23}X_{24}X_8X_9CX_{10}X_{11}CX_{12}X_{13}X_{14}X_{15}X_{16}DPGALVRH X_{17}X_{18}X_{19}HX_{20}X_{21}X_{22}X_{23}X_{24}X_8X_9CX_{10}X_{11}CX_{12}X_{13}X_{14}X_{15}X_{16}TSGELVRH X_{17}X_{18}X_{19}HX_{20}X_{21}X_{22}X_{23}X_{24}X_8X_9CX_{10}X_{11}CX_{12}X_{13}X_{14}X_{15}X_{16}REDNLH THX_{17}X_{18}X_{19}HX_{20}X_{21}X_{22}X_{23}X_{24}X_8X_9CX_{10}X_{11}CX_{12}X_{13}X_{14}X_{15}X_{16}RSDH LTNHX_{17}X_{18}X_{19}HX_{20}X_{21}X_{22}X_{23}X_{24}X_8X_9CX_{10}X_{11}CX_{12}X_{13}X_{14}X_{15}X_{16}RS DKLTEHX_{17}X_{18}X_{19}HX_{20}X_{21}X_{22}X_{23}X_{24}X_{25}X_{26}X_{27}X_{28}X_{29}X_{30}$ | 2089 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| tagaatgcc tgactggg gtg | 992 | TAG AAT GCC TGA CTT GGG GTG | LEPGEKPYKCPECGKSFSRSDEL VRHQRTHTGEKPYKCPECGKSFS RSDKLVRHQRTHTGEKPYKCPEC GKSFSTTGALTEHQRTHTGEKPY KCPECGKSFSQAGHLASHQRTHT GEKPYKCPECGKSFSDCRDLARH QRTHTGEKPYKCPECGKSFSTTG NLTVHQRTHTGEKPYKCPECGKS FSREDNLHTHQRTHTGEKPTGKK TS | 1541 | $X_1X_2X_3X_4X_5X_6X_7X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TTGALTEHX_{17}X_{18}X_{19}HX_{20}X_{21}X_{22}X_{23}X_{24}X_8X_9CX_{10}X_{11}CX_{12}X_{13}X_{14}X_{15}X_{16}QAGHLASH X_{17}X_{18}X_{19}HX_{20}X_{21}X_{22}X_{23}X_{24}X_8X_9CX_{10}X_{11}CX_{12}X_{13}X_{14}X_{15}X_{16}DCRDLA RHX_{17}X_{18}X_{19}HX_{20}X_{21}X_{22}X_{23}X_{24}X_8X_9CX_{10}X_{11}CX_{12}X_{13}X_{14}X_{15}X_{16}TTGN LTVHX_{17}X_{18}X_{19}HX_{20}X_{21}X_{22}X_{23}X_{24}X_8X_9CX_{10}X_{11}CX_{12}X_{13}X_{14}X_{15}X_{16}RE DNLHTHX_{17}X_{18}X_{19}HX_{20}X_{21}X_{22}X_{23}X_{24}X_{25}X_{26}X_{27}X_{28}X_{29}X_{30}$ | 2090 |
| aatgcctga cttgggtg aca | 993 | AAT GCC TGA CTT GGG gtg ACA | LEPGEKPYKCPECGKSFSSPADL TRHQRTHTGEKPYKCPECGKSFS RSDELVRHQRTHTGEKPYKCPEC GKSFSRSDKLVRHQRTHTGEKPY KCPECGKSFSTTGALTEHQRTHT GEKPYKCPECGKSFSQAGHLASH QRTHTGEKPYKCPECGKSFSDCR DLARHQRTHTGEKPYKCPECGKS FSTTGNLTVHQRTHTGEKPTGKK TS | 1542 | $X_1X_2X_3X_4X_5X_6X_7X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TTGALTEH X_{17}X_{18}X_{19}HX_{20}X_{21}X_{22}X_{23}X_{24}X_8X_9CX_{10}X_{11}CX_{12}X_{13}X_{14}X_{15}X_{16}QAGHLA SHX_{17}X_{18}X_{19}HX_{20}X_{21}X_{22}X_{23}X_{24}X_8X_9CX_{10}X_{11}CX_{12}X_{13}X_{14}X_{15}X_{16}DCRD LARHX_{17}X_{18}X_{19}HX_{20}X_{21}X_{22}X_{23}X_{24}X_8X_9CX_{10}X_{11}CX_{12}XEX_{14}X_{15}X_{16}TT GNLTVHX_{17}X_{18}X_{19}HX_{20}X_{21}X_{22}X_{23}X_{24}X_{25}X_{26}X_{27}X_{28}X_{29}X_{30}$ | 2091 |
| agttagaat gcctgactt ggg | 994 | AGT TAG AAT GCC TGA CTT GGG | LEPGEKPYKCPECGKSFSRSDKL VRHQRTHTGEKPYKCPECGKSFS TTGALTEHQRTHTGEKPYKCPEC GKSFSQAGHLASHQRTHTGEKPY KCPECGKSFSDCRDLARHQRTHT GEKPYKCPECGKSFSTTGNLTVH QRTHTGEKPYKCPECGKSFSRED NLHTHQRTHTGEKPYKCPECGKS FSHRTTLTNHQRTHTGEKPTGKK TS | 1543 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TTGALTEHX_{17}X_{18}X_{19}HX_{20}X_{21}X_{22}X_{23}X_{24}X_8X_9CX_{10}X_{11}CX_{12}X_{13}X_{14}X_{15}X_{16}QAGHLASHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARH X_{17}X_{18}X_{19}HX_{20}X_{21}X_{22}X_{23}X_{24}X_8X_9CX_{10}X_{11}CX_{12}X_{13}X_{14}X_{15}X_{16}TTGNLT VHX_{17}X_{18}X_{19}HX_{20}X_{21}X_{22}X_{23}X_{24}X_8X_9CX_{10}X_{11}CX_{12}X_{13}X_{14}X_{15}X_{16}REDN LHTHX_{17}X_{18}X_{19}HX_{20}X_{21}X_{22}X_{23}X_{24}X_8X_9CX_{10}X_{11}CX_{12}X_{13}X_{14}X_{15}X_{16}HR TTLTNHX_{17}X_{18}X_{19}HX_{20}X_{21}X_{22}X_{23}X_{24}X_{25}X_{26}X_{27}X_{28}X_{29}X_{30}$ | 2092 |
| gcctgactt gggtgaca atg | 995 | GCC TGA CTT GGG gtg ACA ATG | LEPGEKPYKCPECGKSFSRRDEL NVHQRTHTGEKPYKCPECGKSFS SPADLTRHQRTHTGEKPYKCPEC GKSFSRSDELVRHQRTHTGEKPY KCPECGKSFSRSDKLVRHQRTHT GEKPYKCPECGKSFSTTGALTEH QRTHTGEKPYKCPECGKSFSQAG HLASHQRTHTGEKPYKCPECGKS FSDCRDLARHQRTHTGEKPTGKK TS | 1544 | $X_1X_2X_3X_4X_5X_6X_7X_8X_9CX_{10}X_{11}CX_{12}X_{13}X_{14}X_{15}X_{16}RRDELNVHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRH X_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRH X_{17}X_{18}X_{19}HX_{20}X_{21}X_{22}X_{23}X_{24}X_8X_9CX_{10}X_{11}CX_{12}X_{13}X_{14}X_{15}X_{16}TTGALT EHX_{17}X_{18}X_{19}HX_{20}X_{21}X_{22}X_{23}X_{24}X_8X_9CX_{10}X_{11}CX_{12}X_{13}X_{14}X_{15}X_{16}QAGH LASHX_{17}X_{18}X_{19}HX_{20}X_{21}X_{22}X_{23}X_{24}X_8X_9CX_{10}X_{11}CX_{12}X_{13}X_{14}X_{15}X_{16}DC RDLARHX_{17}X_{18}X_{19}HX_{20}X_{21}X_{22}X_{23}X_{24}X_{25}X_{26}X_{27}X_{28}X_{29}X_{30}$ | 2093 |

TABLE 10-continued

| Column 1 Nucleotide Sequence of Target Site in HNF4α Expression Control Region | Column 2 Column 3 Target sequence with space | Column 4 Amino acid Sequence of Zinc Finger DNA Binding Domain Polypeptides Targeting the Target Site in Column 1 | Column 5 SEQ ID NO. (corresponds to sequences in Columns 2 and 3) | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|
| ggggtgaca atgctggagg | GGG gtg ACA ATG GCT AGG | LEPGEKPYKCPECGKSFSRSDHL TNHQRTHTGEKPYKCPECGKSFS RSDHLTTHQRTHTGEKPYKCPEC GKSFSTSGELVRHQRTHTGEKPY KCPECGKSFSRRDELNVHQRTHT GEKPYKCPECGKSFSPADLTRH QRTHTGEKPYKCPECGKSFSRSD ELVRHQRTHTGEKPYKCPECGKS FSRSDKLVRHQRTHTGEKPTGKK TS | 996 | $X_1X_2X_3X_4X_5X_6X_7X_8X_9CX_{10}X_{11}CX_{12}X_{13}X_{14}X_{15}X_{16}RSDHLTNHX_{17}X_{18}X_{19}$ $HX_{20}X_{21}X_{22}X_{23}X_{24}X_8X_9CX_{10}X_{11}CX_{12}X_{13}X_{14}X_{15}X_{16}RSDHLTTHX_{17}X_{18}$ $X_{19}HX_{20}X_{21}X_{22}X_{23}X_{24}X_8X_9CX_{10}X_{11}CX_{12}X_{13}X_{14}X_{15}X_{16}TSGELVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}RRDELNVH$ $X_{17}X_{18}X_{19}HX_{20}X_{21}X_{22}X_{23}X_{24}X_8X_9CX_{10}X_{11}CX_{12}X_{13}X_{14}X_{15}X_{16}SPADLT$ $RHX_{17}X_{18}X_{19}HX_{20}X_{21}X_{22}X_{23}X_{24}X_8X_9CX_{10}X_{11}CX_{12}X_{13}X_{14}X_{15}X_{16}RSDE$ $LVRHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DKLVRHX_{17}X_{18}X_{19}HX_{20}X_{21}X_{22}X_{23}X_{24}X_{25}X_{26}X_{27}X_{28}X_{29}X_{30}$ | 2094 |
| tgacttggg tgacaatg gct | TGA CTT GGG gtg ACA ATG GCT | LEPGEKPYKCPECGKSFSTSGEL VRHQRTHTGEKPYKCPECGKSFS RRDELNVHQRTHTGEKPYKCPEC GKSFSSPADLTRHQRTHTGEKPY KCPECGKSFSRSDELVRHQRTHT GEKPYKCPECGKSFSRSDKLVRH QRTHTGEKPYKCPECGKSFSTTG ALTEHQRTHTGEKPYKCPECGKS FSQAGHLASHQRTHTGEKPTGKK TS | 997 | $X_1X_2X_3X_4X_5X_6X_7X_8X_9CX_{10}X_{11}CX_{12}X_{13}X_{14}X_{15}X_{16}TSGELVRHX_{17}X_{18}X_{19}$ $HX_{20}X_{21}X_{22}X_{23}X_{24}X_8X_9CX_{10}X_{11}CX_{12}X_{13}X_{14}X_{15}X_{16}RRDELNVHX_{17}X_{18}$ $X_{19}HX_{20}X_{21}X_{22}X_{23}X_{24}X_8X_9CX_{10}X_{11}CX_{12}X_{13}X_{14}X_{15}X_{16}SPADLTRHX_{17}$ $X_{18}X_{19}HX_{20}X_{21}X_{22}X_{23}X_{24}X_8X_9CX_{10}X_{11}CX_{12}X_{13}X_{14}X_{15}X_{16}RSDELVRH$ $X_{17}X_{18}X_{19}HX_{20}X_{21}X_{22}X_{23}X_{24}X_8X_9CX_{10}X_{11}CX_{12}X_{13}X_{14}X_{15}X_{16}RSDKLV$ $RHX_{17}X_{18}X_{19}HX_{20}X_{21}X_{22}X_{23}X_{24}X_8X_9CX_{10}X_{11}CX_{12}X_{13}X_{14}X_{15}X_{16}TTGA$ $LTEHX_{17}X_{18}X_{19}HX_{20}X_{21}X_{22}X_{23}X_{24}X_8X_9CX_{10}X_{11}CX_{12}X_{13}X_{14}X_{15}X_{16}QA$ $GHLASHX_{17}X_{18}X_{19}HX_{20}X_{21}X_{22}X_{23}X_{24}X_{25}X_{26}X_{27}X_{28}X_{29}X_{30}$ | 2095 |
| cttggggtg acaatggct tgg | CTT GGG gtg ACA ATG GCT TGG | LEPGEKPYKCPECGKSFSRSDHL TTHQRTHTGEKPYKCPECGKSFS TSGELVRHQRTHTGEKPYKCPEC GKSFSRRDELNVHQRTHTGEKPY KCPECGKSSPADLTRHQRTHT GEKPYKCPECGKSFSRSDELVRH QRTHTGEKPYKCPECGKSFSRSD KLVRHQRTHTGEKPYKCPECGKS FSTTGALTEHQRTHTGEKPTGKK TS | 130 | $X_1X_2X_3X_4X_5X_6X_7X_8X_9CX_{10}X_{11}CX_{12}X_{13}X_{14}X_{15}X_{16}RSDHLTTHX_{17}X_{18}X_{19}$ $HX_{20}X_{21}X_{22}X_{23}X_{24}X_8X_9CX_{10}X_{11}CX_{12}X_{13}X_{14}X_{15}X_{16}TSGELVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}RRDELNVHX_{17}$ $X_{18}X_{19}HX_{20}X_{21}X_{22}X_{23}X_{24}X_8X_9CX_{10}X_{11}CX_{12}X_{13}X_{14}X_{15}X_{16}SPADLTRH$ $X_{17}X_{18}X_{19}HX_{20}X_{21}X_{22}X_{23}X_{24}X_8X_9CX_{10}X_{11}CX_{12}X_{13}X_{14}X_{15}X_{16}RSDELV$ $RHX_{17}X_{18}X_{19}HX_{20}X_{21}X_{22}X_{23}X_{24}X_8X_9CX_{10}X_{11}CX_{12}X_{13}X_{14}X_{15}X_{16}RSDK$ $LVRHX_{17}X_{18}X_{19}HX_{20}X_{21}X_{22}X_{23}X_{24}X_8X_9CX_{10}X_{11}CX_{12}XEX_{14}X_{15}X_{16}TT$ $GALTEHX_{17}X_{18}X_{19}HX_{20}X_{21}X_{22}X_{23}X_{24}X_{25}X_{26}X_{27}X_{28}X_{29}X_{30}$ | 320 |
| gcttggagg ggtggtga gtc | GCT TGG AGG GGT GGT TGA GTC | LEPGEKPYKCPECGKSFSDPGAL VRHQRTHTGEKPYKCPECGKSFS QAGHLASHQRTHTGEKPYKCPEC GKSFSRSDKLVRHQRTHTGEKPY KCPECGKSFSTSGHLVRHQRTHT GEKPYKCPECGKSFSRSDHLTNH QRTHTGEKPYKCPECGKSFSRSD HLTTHQRTHTGEKPYKCPECGKS FSTSGELVRHQRTHTGEKPTGKK TS | 998 | $X_1X_2X_3X_4X_5X_6X_7X_8X_9CX_{10}X_{11}CX_{12}X_{13}X_{14}X_{15}X_{16}DPGALVRHX_{17}X_{18}X_{19}$ $HX_{20}X_{21}X_{22}X_{23}X_{24}X_8X_9CX_{10}X_{11}CX_{12}X_{13}X_{14}X_{15}X_{16}QAGHLASHX_{17}X_{18}$ $X_{19}HX_{20}X_{21}X_{22}X_{23}X_{24}X_8X_9CX_{10}X_{11}CX_{12}X_{13}X_{14}X_{15}X_{16}RSDKLVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}TSGHLVRH$ $X_{17}X_{18}X_{19}HX_{20}X_{21}X_{22}X_{23}X_{24}X_8X_9CX_{10}X_{11}CX_{12}X_{13}X_{14}X_{15}X_{16}RSDHLT$ $NHX_{17}X_{18}X_{19}HX_{20}X_{21}X_{22}X_{23}X_{24}X_8X_9CX_{10}X_{11}CX_{12}X_{13}X_{14}X_{15}X_{16}RSDH$ $LTTHX_{17}X_{18}X_{19}HX_{20}X_{21}X_{22}X_{23}X_{24}X_8X_9CX_{10}X_{11}CX_{12}X_{13}X_{14}X_{15}X_{16}TS$ $GELVRHX_{17}X_{18}X_{19}HX_{20}X_{21}X_{22}X_{23}X_{24}X_{25}X_{26}X_{27}X_{28}X_{29}X_{30}$ | 2096 |

TABLE 10-continued

| Column 1 Nucleotide Sequence of Target Site in HNF4α Expression Control Region | Column 3 Target sequence with space | Column 2 SEQ ID NO. (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| tggaggggt gggtagtc aag | TGG AGG GGT TGA GTC APG | 999 | LEPGEKPYKCPECGKSFSRKDNL KNHQRTHTGEKPYKCPECGKSFS DPGALVRHQRTHTGEKPYKCPEC GKSFSQAGHLASHQRTHTGEKPY KCPECGKSFSRSDKLVRHQRTHT GEKPYKCPECGKSFSTSGHLVRH QRTHTGEKPYKCPECGKSFSRSD HLTNHQRTHTGEKPYKCPECGKS FSRSDHLTTHQRTHTGEKPTGKK TS | 1548 | $X_1X_2X_3X_4X_5X_6X_7X_8X_9CX_{10}X_{11}CX_{12}X_{13}X_{14}X_{15}X_{16}RKDNLKNHX_{17}X_{18}X_{19}$ $HX_{20}X_{21}X_{22}X_{23}X_{24}X_8X_9CX_{10}X_{11}CX_{12}X_{13}X_{14}X_{15}X_{16}DPGALVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}QAGHLASHX_{17}$ $X_{18}X_{19}HX_{20}X_{21}X_{22}X_{23}X_{24}X_8X_9CX_{10}X_{11}CX_{12}X_{13}X_{14}X_{15}X_{16}RSDKLVRH$ $X_{17}X_{18}X_{19}HX_{20}X_{21}X_{22}X_{23}X_{24}X_8X_9CX_{10}X_{11}CX_{12}X_{13}X_{14}X_{15}X_{16}TSGHLV$ $RHX_{17}X_{18}X_{19}HX_{20}X_{21}X_{22}X_{23}X_{24}X_8X_9CX_{10}X_{11}CX_{12}X_{13}X_{14}X_{15}X_{16}RSDH$ $LTNHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DHLTTHX_{17}X_{18}X_{19}HX_{20}X_{21}X_{22}X_{23}X_{24}X_{25}X_{26}X_{27}X_{28}X_{29}X_{30}$ | 2097 |
| gtgacaatg gctggagg ggt | gtg ACA ATG GCT GAG GGT | 1000 | LEPGEKPYKCPECGKSFSTSGHL VRHQRTHTGEKPYKCPECGKSFS RSDHLTNHQRTHTGEKPYKCPEC GKSFSRSDHLTTHQRTHTGEKPY KCPECGKSFSTSGELVRHQRTHT GEKPYKCPECGKSFSRRDELNVH QRTHTGEKPYKCPECGKSFSSPA DLTRHQRTHTGEKPYKCPECGKS FSRSDELVRHQRTHTGEKPTGKK TS | 1549 | $X_1X_2X_3X_4X_5X_6X_7X_8X_9CX_{10}X_{11}CX_{12}X_{13}X_{14}X_{15}X_{16}TSGHLVRHX_{17}X_{18}X_{19}$ $HX_{20}X_{21}X_{22}X_{23}X_{24}X_8X_9CX_{10}X_{11}CX_{12}X_{13}X_{14}X_{15}X_{16}RSDHLTNHX_{17}X_{18}$ $X_{19}HX_{20}X_{21}X_{22}X_{23}X_{24}X_8X_9CX_{10}X_{11}CX_{12}X_{13}X_{14}X_{15}X_{16}RSDHLTTHX_{17}$ $X_{18}X_{19}HX_{20}X_{21}X_{22}X_{23}X_{24}X_8X_9CX_{10}X_{11}CX_{12}X_{13}X_{14}X_{15}X_{16}TSGELVRH$ $X_{27}X_{18}X_{19}HX_{20}X_{21}X_{22}X_{23}X_{24}X_8X_9CX_{10}X_{11}CX_{12}X_{13}X_{14}X_{15}X_{16}RRDELN$ $VHX_{17}X_{18}X_{19}HX_{20}X_{21}X_{22}X_{23}X_{24}X_8X_9CX_{10}X_{11}CX_{12}X_{13}X_{14}X_{15}X_{16}SPAD$ $LTRHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DELVRHX_{17}X_{18}X_{19}HX_{20}X_{21}X_{22}X_{23}X_{24}X_{25}X_{26}X_{27}X_{28}X_{29}X_{30}$ | 2098 |
| atggcttgg aggggtggg tga | ATG GCT TGG AGG GGT GGG TGA | 1001 | LEPGEKPYKCPECGKSFSQAGHL ASHQRTHTGEKPYKCPECGKSFS RSDKLVRHQRTHTGEKPYKCPEC GKSFSTSGHLVRHQRTHTGEKPY KCPECGKSFSRSDHLTNHQRTHT GEKPYKCPECGKSFSRSDHLTTH QRTHTGEKPYKCPECGKSFSTSG ELVRHQRTHTGEKPYKCPECGKS FSRRDELNVHQRTHTGEKPTGKK TS | 1550 | $X_1X_2X_3X_4X_5X_6X_7X_8X_9CX_{10}X_{11}CX_{12}X_{13}X_{14}X_{15}X_{16}QAGHLASHX_{17}X_{18}X_{19}$ $HX_{20}X_{21}X_{22}X_{23}X_{24}X_8X_9CX_{10}X_{11}CX_{12}X_{13}X_{14}X_{15}X_{16}RSDKLVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}TSGHLVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}RSDHLTNH$ $X_{17}X_{18}X_{19}HX_{20}X_{21}X_{22}X_{23}X_{24}X_8X_9CX_{10}X_{11}CX_{12}X_{13}X_{14}X_{15}X_{16}RSDHLT$ $THX_{17}X_{18}X_{19}HX_{20}X_{21}X_{22}X_{23}X_{24}X_8X_9CX_{10}X_{11}CX_{12}X_{13}X_{14}X_{15}X_{16}TSGE$ $LVRHX_{17}X_{18}X_{19}HX_{20}X_{21}X_{22}X_{23}X_{24}X_8X_9CX_{10}X_{11}CX_{12}X_{13}X_{14}X_{15}X_{16}RR$ $DELNVHX_{17}X_{18}X_{19}HX_{20}X_{21}X_{22}X_{23}X_{24}X_{25}X_{26}X_{27}X_{28}X_{29}X_{30}$ | 2099 |
| acaatggct tggagggt ggg | ACA ATG GCT TGG AGG GGT GGG | 1002 | LEPGEKPYKCPECGKSFSRSDKL VRHQRTHTGEKPYKCPECGKSFS TSGHLVRHQRTHTGEKPYKCPEC GKSFSRSDHLTNHQRTHTGEKPY KCPECGKSFSRSDHLTTHQRTHT GEKPYKCPECGKSFSTSGELVRH QRTHTGEKPYKCPECGKSFSRRD ELNVHQRTHTGEKPYKCPECGKS FSSPADLTRHQRTHTGEKPTGKK TS | 1551 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}$ $HX_{20}X_{21}X_{22}X_{23}X_{24}X_8X_9CX_{10}X_{11}CX_{12}X_{13}X_{14}X_{15}X_{16}TSGHLVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}RSDHLTNHX_{17}$ $X_{18}X_{19}HX_{20}X_{21}X_{22}X_{23}X_{24}X_8X_9CX_{10}X_{11}CX_{12}X_{13}X_{14}X_{15}X_{16}RSDHLTTH$ $X_{17}X_{18}X_{19}HX_{20}X_{21}X_{22}X_{23}X_{24}X_8X_9CX_{10}X_{11}CX_{12}X_{13}X_{14}X_{15}X_{16}TSGELV$ $RHX_{17}X_{18}X_{19}HX_{20}X_{21}X_{22}X_{23}X_{24}X_8X_9CX_{10}X_{11}CX_{12}X_{13}X_{14}X_{15}X_{16}RRDE$ $LNVHX_{17}X_{18}X_{19}HX_{20}X_{21}X_{22}X_{23}X_{24}X_8X_9CX_{10}X_{11}CX_{12}X_{13}X_{14}X_{15}X_{16}SP$ $ADLTRHX_{17}X_{18}X_{19}HX_{20}X_{21}X_{22}X_{23}X_{24}X_{25}X_{26}X_{27}X_{28}X_{29}X_{30}$ | 2100 |

TABLE 10-continued

| Column 1 Nucleotide Sequence of Target Site in HNF4α Expression Control Region | Column 2 Target sequence with space | Column 3 Target sequence | Column 4 Amino acid Sequence of Zinc Finger DNA Binding Domain Polypeptides Targeting the Target Site in Column 1 | Column 5 SEQ ID NO. (corresponds to sequences in Columns 2 and 3) | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gggtgagtc aagggtcaa atg | GGG TGA GTC AAG GGT CAA ATG | | LEPGEKPYKCPECGKSFSRRDEL NVHQRTHTGEKPYKCPECGKSFS QSGNLTEHQRTHTGEKPYKCPEC GKSFSTSGHLVRHQRTHTGEKPY KCPECGKSFSRKDNLKNHQRTHT GEKPYKCPECGKSFSDPGALVRH QRTHTGEKPYKCPECGKSFSQAG HLASHQRTHTGEKPYKCPECGKS FSRSDKLVRHQRTHTGEKPTGKK TS | 1003 | $X_1X_2X_3X_4X_5X_6X_7X_8X_9CX_{10}X_{11}CX_{12}X_{13}X_{14}X_{15}X_{16}RRDELNVHX_{17}X_{18}X_{19}$ $HX_{20}X_{21}X_{22}X_{23}X_{24}X_8X_9CX_{10}X_{11}CX_{12}X_{13}X_{14}X_{15}X_{16}QSGNLTEHX_{17}X_{18}$ $X_{19}HX_{20}X_{21}X_{22}X_{23}X_{24}X_8X_9CX_{10}X_{11}CX_{12}X_{13}X_{14}X_{15}X_{16}TSGHLVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}RKDNLKNH$ $X_{17}X_{18}X_{19}HX_{20}X_{21}X_{22}X_{23}X_{24}X_8X_9CX_{10}X_{11}CX_{12}X_{13}X_{14}X_{15}X_{16}DPGALV$ $RHX_{17}X_{18}X_{19}HX_{20}X_{21}X_{22}X_{23}X_{24}X_8X_9CX_{10}X_{11}CX_{12}X_{13}X_{14}X_{15}X_{16}QAGH$ $LASHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DKLVRHX_{17}X_{18}X_{19}HX_{20}X_{21}X_{22}X_{23}X_{24}X_{25}X_{26}X_{27}X_{28}X_{29}X_{30}$ | 2101 |
| ggtcaaatg agtgcccgt gag | GGT CAA ATG AGT GCC CGT GAG | | LEPGEKPYKCPECGKSFSRSDNL VRHQRTHTGEKPYKCPECGKSFS SRRTCRAHQRTHTGEKPYKCPEC GKSFSDCRDLARHQRTHTGEKPY KCPECGKSFSHRTTLTNHQRTHT GEKPYKCPECGKSFSRRDELNVH QRTHTGEKPYKCPECGKSFSQSG NLTEHQRTHTGEKPYKCPECGKS FSTSGHLVRHQRTHTGEKPTGKK TS | 1004 | $X_1X_2X_3X_4X_5X_6X_7X_8X_9CX_{10}X_{11}CX_{12}X_{13}X_{14}X_{15}X_{16}RSDNLVRHX_{17}X_{18}X_{19}$ $HX_{20}X_{21}X_{22}X_{23}X_{24}X_8X_9CX_{10}X_{11}CX_{12}X_{13}X_{14}X_{15}X_{16}SRRTCRAHX_{17}X_{18}$ $X_{19}HX_{20}X_{21}X_{22}X_{23}X_{24}X_8X_9CX_{10}X_{11}CX_{12}X_{13}X_{14}X_{15}X_{16}DCRDLARHX_{17}$ $X_{18}X_{19}HX_{20}X_{21}X_{22}X_{23}X_{24}X_8X_9CX_{10}X_{11}CX_{12}X_{13}X_{14}X_{15}X_{16}HRTTLTNH$ $X_{17}X_{18}X_{19}HX_{20}X_{21}X_{22}X_{23}X_{24}X_8X_9CX_{10}X_{11}CX_{12}X_{13}X_{14}X_{15}X_{16}RRDELN$ $VHX_{17}X_{18}X_{19}HX_{20}X_{21}X_{22}X_{23}X_{24}X_8X_9CX_{10}X_{11}CX_{12}X_{13}X_{14}X_{15}X_{16}QSGN$ $LTEHX_{17}X_{18}X_{19}HX_{20}X_{21}X_{22}X_{23}X_{24}X_8X_9CX_{10}X_{11}CX_{12}X_{13}X_{14}X_{15}X_{16}TS$ $GHLVRHX_{17}X_{18}X_{19}HX_{20}X_{21}X_{22}X_{23}X_{24}X_{25}X_{26}X_{27}X_{28}X_{29}X_{30}$ | 2102 |
| tgagtcaag ggtcaaatg agt | TGA GTC AAG GGT CAA ATG AGT | | LEPGEKPYKCPECGKSFSHRTTL TNHQRTHTGEKPYKCPECGKSFS RRDELNVHQRTHTGEKPYKCPEC GKSFSQSGNLTEHQRTHTGEKPY KCPECGKSFSTSGHLVRHQRTHT GEKPYKCPECGKSFSRKDNLKNH QRTHTGEKPYKCPECGKSFSDPG ALVRHQRTHTGEKPYKCPECGKS FSQAGHLASHQRTHTGEKPTGKK TS | 1005 | $X_1X_2X_3X_4X_5X_6X_7X_8X_9CX_{10}X_{11}CX_{12}X_{13}X_{14}X_{15}X_{16}HRTTLTNHX_{17}X_{18}X_{19}$ $HX_{20}X_{21}X_{22}X_{23}X_{24}X_8X_9CX_{10}X_{11}CX_{12}X_{13}X_{14}X_{15}X_{16}RRDELNVHX_{17}X_{18}$ $X_{19}HX_{20}X_{21}X_{22}X_{23}X_{24}X_8X_9CX_{10}X_{11}CX_{12}X_{13}X_{14}X_{15}X_{16}QSGNLTEHX_{17}$ $X_{18}X_{19}HX_{20}X_{21}X_{22}X_{23}X_{24}X_8X_9CX_{10}X_{11}CX_{12}X_{13}X_{14}X_{15}X_{16}TSGHLVRH$ $X_{17}X_{18}X_{19}HX_{20}X_{21}X_{22}X_{23}X_{24}X_8X_9CX_{10}X_{11}CX_{12}X_{13}X_{14}X_{15}X_{16}RKDNLK$ $NHX_{17}X_{18}X_{19}HX_{20}X_{21}X_{22}X_{23}X_{24}X_8X_9CX_{10}X_{11}CX_{12}X_{13}X_{14}X_{15}X_{16}DPGA$ $LVRHX_{17}X_{18}X_{19}HX_{20}X_{21}X_{22}X_{23}X_{24}X_8X_9CX_{10}X_{11}CX_{12}X_{13}X_{14}X_{15}X_{16}QA$ $GHLASHX_{17}X_{18}X_{19}HX_{20}X_{21}X_{22}X_{23}X_{24}X_{25}X_{26}X_{27}X_{28}X_{29}X_{30}$ | 2103 |
| gtcaaggggt caaatgagt gcc | GTC AAG GGT CAA ATG AGT GCC | | LEPGEKPYKCPECGKSFSDCRDL ARHQRTHTGEKPYKCPECGKSFS HRTTLTNHQRTHTGEKPYKCPEC GKSFSRRDELNVHQRTHTGEKPY KCPECGKSFSQSGNLTEHQRTHT GEKPYKCPECGKSFSTSGHLVRH QRTHTGEKPYKCPECGKSFSRKD NLKNHQRTHTGEKPYKCPECGKS FSDPGALVRHQRTHTGEKPTGKK TS | 1006 | $X_1X_2X_3X_4X_5X_6X_7X_8X_9CX_{10}X_{11}CX_{12}X_{13}X_{14}X_{15}X_{16}DCRDLARHX_{17}X_{18}X_{19}$ $HX_{20}X_{21}X_{22}X_{23}X_{24}X_8X_9CX_{10}X_{11}CX_{12}X_{13}X_{14}X_{15}X_{16}HRTTLTNHX_{17}X_{18}$ $X_{19}HX_{20}X_{21}X_{22}X_{23}X_{24}X_8X_9CX_{10}X_{11}CX_{12}X_{13}X_{14}X_{15}X_{16}RRDELNVHX_{17}$ $X_{18}X_{19}HX_{20}X_{21}X_{22}X_{23}X_{24}X_8X_9CX_{10}X_{11}CX_{12}X_{13}X_{14}X_{15}X_{16}QSGNLTEH$ $X_{17}X_{18}X_{19}HX_{20}X_{21}X_{22}X_{23}X_{24}X_8X_9CX_{10}X_{11}CX_{12}X_{13}X_{14}X_{15}X_{16}TSGHLV$ $RHX_{17}X_{18}X_{19}HX_{20}X_{21}X_{22}X_{23}X_{24}X_8X_9CX_{10}X_{11}CX_{12}X_{13}X_{14}X_{15}X_{16}RKDN$ $LKNHX_{17}X_{18}X_{19}HX_{20}X_{21}X_{22}X_{23}X_{24}X_8X_9CX_{10}X_{11}CX_{12}X_{13}X_{14}X_{15}X_{16}DP$ $GALVRHX_{17}X_{18}X_{19}HX_{20}X_{21}X_{22}X_{23}X_{24}X_{25}X_{26}X_{27}X_{28}X_{29}X_{30}$ | 2104 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| aagggtcaa atgagtgcc cgt | 1007 | AAG GGT CAA ATG AGT GCC CGT | LEPGEKPYKCPECGKSFSSRRTC RAHQRTHTGEKPYKCPECGKSFS DCRDLARHQRTHTGEKPYKCPEC GKSFSHRTTLTNHQRTHTGEKPY KCPECGKSFSRRDELNVHQRTHT GEKPYKCPECGKSFSQSGNLTEH QRTHTGEKPYKCPECGKSFSTSG HLVRHQRTHTGEKPYKCPECGKS FSRKDNLKNHQRTHTGEKPTGKK TS | 1556 | $X_1X_2X_3X_4X_5X_6X_7X_8X_9CX_{10}X_{11}CX_{12}X_{13}X_{14}X_{15}X_{16}SRRTCRAHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}HRTTLTNHX_{17}X_{18}X_{19}HX_{20}X_{21}X_{22}X_{23}X_{24}X_8X_9CX_{10}X_{11}CX_{12}X_{13}X_{14}X_{15}X_{16}RRDELNVH X_{17}X_{18}X_{19}HX_{20}X_{21}X_{22}X_{23}X_{24}X_8X_9CX_{10}X_{11}CX_{12}X_{13}X_{14}X_{15}X_{16}QSGNLT EHX_{17}X_{18}X_{19}HX_{20}X_{21}X_{22}X_{23}X_{24}X_8X_9CX_{10}X_{11}CX_{12}X_{13}X_{14}X_{15}X_{16}TSGH LVRHX_{17}X_{18}X_{19}HX_{20}X_{21}X_{22}X_{23}X_{24}X_8X_9CX_{10}X_{11}CX_{12}X_{13}X_{14}X_{15}X_{16}RK DNLKNHX_{17}X_{18}X_{19}HX_{20}X_{21}X_{22}X_{23}X_{24}X_{25}X_{26}X_{27}X_{28}X_{29}X_{30}$ | 2105 |
| agggtggg tgagtcaag ggt | 1008 | AGG GGT GGG TGA GTC AAG GGT | LEPGEKPYKCPECGKSFSTSGHL VRHQRTHTGEKPYKCPECGKSFS RKDNLKNHQRTHTGEKPYKCPEC GKSFSDPGALVRHQRTHTGEKPY KCPECGKSFSQAGHLASHQRTHT GEKPYKCPECGKSFSRSDKLVRH QRTHTGEKPYKCPECGKSFSTSG HLVRHQRTHTGEKPYKCPECGKS FSRSDHLTNHQRTHTGEKPTGKK TS | 1557 | $X_1X_2X_3X_4X_5X_6X_7X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RKDNLKNHX_{17}X_{18}X_{19}HX_{20}X_{21}X_{22}X_{23}X_{24}X_8X_9CX_{10}X_{11}CX_{12}X_{13}X_{14}X_{15}X_{16}DPGALVRHX_{17}X_{18}X_{19}HX_{20}X_{21}X_{22}X_{23}X_{24}X_8X_9CX_{10}X_{11}CX_{12}X_{13}X_{14}X_{15}X_{16}QAGHLASH X_{17}X_{18}X_{19}HX_{20}X_{21}X_{22}X_{23}X_{24}X_8X_9CX_{10}X_{11}CX_{12}X_{13}X_{14}X_{15}X_{16}RSDKLV RHX_{17}X_{18}X_{19}HX_{20}X_{21}X_{22}X_{23}X_{24}X_8X_9CX_{10}X_{11}CX_{12}X_{13}X_{14}X_{15}X_{16}TSGH LVRHX_{17}X_{18}X_{19}HX_{20}X_{21}X_{22}X_{23}X_{24}X_8X_9CX_{10}X_{11}CX_{12}X_{13}X_{14}X_{15}X_{16}RS DHLTNHX_{17}X_{18}X_{19}HX_{20}X_{21}X_{22}X_{23}X_{24}X_{25}X_{26}X_{27}X_{28}X_{29}X_{30}$ | 2106 |
| ggtgggtga gtcaagggt caa | 1009 | GGT GGG TGA GTC AAG GGT CAA | LEPGEKPYKCPECGKSFSQSGNL TEHQRTHTGEKPYKCPECGKSFS TSGHLVRHQRTHTGEKPYKCPEC GKSFSRKDNLKNHQRTHTGEKPY KCPECGKSFSDPGALVRHQRTHT GEKPYKCPECGKSFSQAGHLASH QRTHTGEKPYKCPECGKSFSRSD KLVRHQRTHTGEKPYKCPECGKS FSTSGHLVRHQRTHTGEKPTGKK TS | 1558 | $X_1X_2X_3X_4X_5X_6X_7X_8X_9CX_{10}X_{11}CX_{12}X_{13}X_{14}X_{15}X_{16}QSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RKDNLKNHX_{17}X_{18}X_{19}HX_{20}X_{21}X_{22}X_{23}X_{24}X_8X_9CX_{10}X_{11}CX_{12}X_{13}X_{14}X_{15}X_{16}DPGALVRH X_{17}X_{18}X_{19}HX_{20}X_{21}X_{22}X_{23}X_{24}X_8X_9CX_{10}X_{11}CX_{12}X_{13}X_{14}X_{15}X_{16}QAGHLA SHX_{17}X_{18}X_{19}HX_{20}X_{21}X_{22}X_{23}X_{24}X_8X_9CX_{10}X_{11}CX_{12}X_{13}X_{14}X_{15}X_{16}RSDK LVRHX_{17}X_{18}X_{19}HX_{20}X_{21}X_{22}X_{23}X_{24}X_8X_9CX_{10}X_{11}CX_{12}X_{13}X_{14}X_{15}X_{16}TS GHLVRHX_{17}X_{18}X_{19}HX_{20}X_{21}X_{22}X_{23}X_{24}X_{25}X_{26}X_{27}X_{28}X_{29}X_{30}$ | 2107 |
| ctgacttgg ggtgacaat ggc | 1010 | CTG ACT TGG GGT GAC AAT GGC | LEPGEKPYKCPECGKSFSDPGHL VRHQRTHTGEKPYKCPECGKSFS TTGNLTVHQRTHTGEKPYKCPEC GKSFSDPGNLVRHQRTHTGEKPY KCPECGKSFSTSGHLVRHQRTHT GEKPYKCPECGKSFSRSDHLTTH QRTHTGEKPYKCPECGKSFSTHL DLIRHQRTHTGEKPYKCPECGKS FSRNDALTEHQRTHTGEKPTGKK TS | 1559 | $X_1X_2X_3X_4X_5X_6X_7X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}TTGNLTVHX_{17}X_{18}X_{19}HX_{20}X_{21}X_{22}X_{23}X_{24}X_8X_9CX_{10}X_{11}CX_{12}X_{13}X_{14}X_{15}X_{16}DPGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRH X_{17}X_{18}X_{19}HX_{20}X_{21}X_{22}X_{23}X_{24}X_8X_9CX_{10}X_{11}CX_{12}X_{13}X_{14}X_{15}X_{16}RSDHLT THX_{17}X_{18}X_{19}HX_{20}X_{21}X_{22}X_{23}X_{24}X_8X_9CX_{10}X_{11}CX_{12}X_{13}X_{14}X_{15}X_{16}THLD LIRHX_{17}X_{18}X_{19}HX_{20}X_{21}X_{22}X_{23}X_{24}X_8X_9CX_{10}X_{11}CX_{12}X_{13}X_{14}X_{15}X_{16}RN DALTEHX_{17}X_{18}X_{19}HX_{20}X_{21}X_{22}X_{23}X_{24}X_{25}X_{26}X_{27}X_{28}X_{29}X_{30}$ | 2108 |

TABLE 10-continued

| Column 1 Nucleotide Sequence of Target Site in HNF4α Expression Control Region | Column 2 Target sequence with space | Column 3 SEQ ID NO. (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gggtgacaa tggcttgga ggg | GGG TGA CAA TGG CTT GGA GGG | 1011 | LEPGEKPYKCPECGKSFSRSDKL VRHQRTHTGEKPYKCPECGKSFS QRAHLERHQRTHTGEKPYKCPEC GKSFSTTGALTEHQRTHTGEKPY KCPECGKSFSRSDHLTTHQRTHT GEKPYKCPECGKSFSQSGNLTEH QRTHTGEKPYKCPECGKSFSQAG HLASHQRTHTGEKPYKCPECGKS FSRSDKLVRHQRTHTGEKPTGKK TS | 1560 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}TTGALTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTH X_{17}X_{18}X_{19}HX_{20}X_{21}X_{22}X_{23}X_{24}X_8X_9CX_{10}X_{11}CX_{12}X_{13}X_{14}X_{15}X_{16}QSGNLT EHX_{17}X_{18}X_{19}HX_{20}X_{21}X_{22}X_{23}X_{24}X_8X_9CX_{10}X_{11}CX_{12}X_{13}X_{14}X_{15}X_{16}QAGH LASHX_{17}X_{18}X_{19}HX_{20}X_{21}X_{22}X_{23}X_{24}X_8X_9CX_{10}X_{11}CX_{12}X_{13}X_{14}X_{15}X_{16}RS DKLVRHX_{17}X_{18}X_{19}HX_{20}X_{21}X_{22}X_{23}X_{24}X_{25}X_{26}X_{27}X_{28}X_{29}X_{30}$ | 2109 |
| tgacaatgg cttggaggg gtg | TGA CAA TGG CTT GGA GGG GTG | 1012 | LEPGEKPYKCPECGKSFSRSDEL VRHQRTHTGEKPYKCPECGKSFS RSDKLVRHQRTHTGEKPYKCPEC GKSFSQRAHLERHQRTHTGEKPY KCPECGKSFSTTGALTEHQRTHT GEKPYKCPECGKSFSRSDHLTTH QRTHTGEKPYKCPECGKSFSQSG NLTEHQRTHTGEKPYKCPECGKS FSQAGHLASHQRTHTGEKPTGKK TS | 1561 | $X_1X_2X_3X_4X_5X_6X_7X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}TTGALTEH X_{17}X_{18}X_{19}HX_{20}X_{21}X_{22}X_{23}X_{24}X_8X_9CX_{10}X_{11}CX_{12}X_{13}X_{14}X_{15}X_{16}RSDHLT THX_{17}X_{18}X_{19}HX_{20}X_{21}X_{22}X_{23}X_{24}X_8X_9CX_{10}X_{11}CX_{12}X_{13}X_{14}X_{15}X_{16}QSGN LTEHX_{17}X_{18}X_{19}HX_{20}X_{21}X_{22}X_{23}X_{24}X_8X_9CX_{10}X_{11}CX_{12}X_{13}X_{14}X_{15}X_{16}QA GHLASHX_{17}X_{18}X_{19}HX_{20}X_{21}X_{22}X_{23}X_{24}X_{25}X_{26}X_{27}X_{28}X_{29}X_{30}$ | 2110 |
| tggcttgga gggtgggtgt gag | TGG CTT GGA GGG GTG GGT GAG | 1013 | LEPGEKPYKCPECGKSFSRSDNL VRHQRTHTGEKPYKCPECGKSFS TSGHLVRHQRTHTGEKPYKCPEC GKSFSRSDELVRHQRTHTGEKPY KCPECGKSFSRSDKLVRHQRTHT GEKPYKCPECGKSFSQRAHLERH QRTHTGEKPYKCPECGKSFSTTG ALTEHQRTHTGEKPYKCPECGKS FSRSDHLTTHQRTHTGEKPTGKK TS | 1562 | $X_1X_2X_3X_4X_5X_6X_7X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}Z15X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRH X_{17}X_{18}X_{19}HX_{20}X_{21}X_{22}X_{23}X_{24}X_8X_9CX_{10}X_{11}CX_{12}X_{13}X_{14}X_{15}X_{16}QRAHLE RHX_{17}X_{18}X_{19}HX_{20}X_{21}X_{22}X_{23}X_{24}X_8X_9CX_{10}X_{11}CX_{12}X_{13}X_{14}X_{15}X_{16}TTGA LTEHX_{17}X_{18}X_{19}HX_{20}X_{21}X_{22}X_{23}X_{24}X_8X_9CX_{10}X_{11}CX_{12}X_{13}X_{14}X_{15}X_{16}RS DHLTTHX_{17}X_{18}X_{19}HX_{20}X_{21}X_{22}X_{23}X_{24}X_{25}X_{26}X_{27}X_{28}X_{29}X_{30}$ | 2111 |
| caatgcctt ggaggggtg ggt | CAA TGG CTT GGA GGG GTG GGT | 1014 | LEPGEKPYKCPECGKSFSTSGHL VRHQRTHTGEKPYKCPECGKSFS RSDELVRHQRTHTGEKPYKCPEC GKSFSRSDKLVRHQRTHTGEKPY KCPECGKSFSQRAHLERHQRTHT GEKPYKCPECGKSFSTTGALTEH QRTHTGEKPYKCPECGKSFSRSD HLTTHQRTHTGEKPYKCPECGKS FSQSGNLTEHQRTHTGEKPTGKK TS | 1563 | $X_1X_2X_3X_4X_5X_6X_7X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERH X_{17}X_{18}X_{19}HX_{20}X_{21}X_{22}X_{23}X_{24}X_8X_9CX_{10}X_{11}CX_{12}X_{13}X_{14}X_{15}X_{16}TTGALT EHX_{17}X_{18}X_{19}HX_{20}X_{21}X_{22}X_{23}X_{24}X_8X_9CX_{10}X_{11}CX_{12}X_{13}X_{14}X_{15}X_{16}RSDH LTTHX_{17}X_{18}X_{19}HX_{20}X_{21}X_{22}X_{23}X_{24}X_8X_9CX_{10}X_{11}CX_{12}X_{13}X_{14}X_{15}X_{16}QS GNLTEHX_{17}X_{18}X_{19}HX_{20}X_{21}X_{22}X_{23}X_{24}X_{25}X_{26}X_{27}X_{28}X_{29}X_{30}$ | 2112 |

TABLE 10-continued

| Column 1 Nucleotide Sequence of Target Site in HNF4α Expression Control Region | Column 2 Column 3 Target sequence with space | Column 4 SEQ ID NO. (corresponds to sequences in Columns 1 and 3) | Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gagggtgg gtgagtcaa ggg | GAG GGT TGG AGT CAA GGG | 1015 | LEPGEKPYKCPECGKSFSRSDKL VRHQRTHTGEKPYKCPECGKSFS QSGNLTEHQRTHTGEKPYKCPEC GKSFSHRTTLTNHQRTHTGEKPY KCPECGKSFSRSDELVRHQRTHT GEKPYKCPECGKSFSRSDHLTTH QRTHTGEKPYKCPECGKSFSRSD KLVRHQRTHTGEKPYKCPECGKS FSRSDNLVRHQRTHTGEKPTGKK TS | 1564 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}HRTTLTNHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_{25}X_{26}X_{27}X_{28}X_{29}X_{30}$ | 2113 |
| agggtcaaa tgagtgccc gtg | AGG GTC AAA TGA gtg CCC GTG | 1016 | LEPGEKPYKCPECGKSFSRSDEL VRHQRTHTGEKPYKCPECGKSFS SKKHLAEHQRTHTGEKPYKCPEC GKSFSRSDELVRHQRTHTGEKPY KCPECGKSFSQAGHLASHQRTHT GEKPYKCPECGKSFSQRANLRAH QRTHTGEKPYKCPECGKSFSDPG ALVRHQRTHTGEKPYKCPECGKS FSRSDHLTNHQRTHTGEKPTGKK TS | 1565 | $X_1X_2X_3X_4X_5X_6X_7X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}QAGHLASHX_{17}X_{18}X_{19}HX_{20}X_{21}X_{22}X_{23}X_{24}X_8X_9CX_{10}X_{11}CX_{12}X_{13}X_{14}X_{15}X_{16}QRANLRAHX_{17}X_{18}X_{19}HX_{20}X_{21}X_{22}X_{23}X_{24}X_8X_9CX_{10}X_{11}CX_{12}X_{13}X_{14}X_{15}X_{16}DPGALVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_{25}X_{26}X_{27}X_{28}X_{29}X_{30}$ | 2114 |
| gtcaaatga gtgccgtg agt | GTC AAA TGA gtg CCC gtg AGT | 1017 | LEPGEKPYKCPECGKSFSHRTTL TNHQRTHTGEKPYKCPECGKSFS RSDELVRHQRTHTGEKPYKCPEC GKSFSSKKHLAEHQRTHTGEKPY KCPECGKSFSRSDELVRHQRTHT GEKPYKCPECGKSFSQAGHLASH QRTHTGEKPYKCPECGKSFSQRA NLRAHQRTHTGEKPYKCPECGKS FSDPGALVRHQRTHTGEKPTGKK TS | 1566 | $X_1X_2X_3X_4X_5X_6X_7X_8X_9CX_{10}X_{11}CX_{12}X_{13}X_{14}X_{15}X_{16}HRTTLTNHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}QAGHLASHX_{17}X_{18}X_{19}HX_{20}X_{21}X_{22}X_{23}X_{24}X_8X_9CX_{10}X_{11}CX_{12}X_{13}X_{14}X_{15}X_{16}QRANLRAHX_{17}X_{18}X_{19}HX_{20}X_{21}X_{22}X_{23}X_{24}X_8X_9CX_{10}X_{11}CX_{12}X_{13}X_{14}X_{15}X_{16}DPGALVRHX_{17}X_{18}X_{19}HX_{20}X_{21}X_{22}X_{23}X_{24}X_{25}X_{26}X_{27}X_{28}X_{29}X_{30}$ | 2115 |
| aaatgagtg cccgtgagt cat | AAA TGA gtg CCC gtg AGT CAT | 1018 | LEPGEKPYKCPECGKSFSTSGNL TEHQRTHTGEKPYKCPECGKSFS HRTTLTNHQRTHTGEKPYKCPEC GKSFSRSDELVRHQRTHTGEKPY KCPECGKSFSSKKHLAEHQRTHT GEKPYKCPECGKSFSRSDELVRH QRTHTGEKPYKCPECGKSFSQAG HLASHQRTHTGEKPYKCPECGKS FSQRANLRAHQRTHTGEKPTGKK TS | 1567 | $X_1X_2X_3X_4X_5X_6X_7X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}HRTTLTNHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}QAGHLASHX_{17}X_{18}X_{19}HX_{20}X_{21}X_{22}X_{23}X_{24}X_8X_9CX_{10}X_{11}CX_{12}X_{13}X_{14}X_{15}X_{16}QRANLRAHX_{17}X_{18}X_{19}HX_{20}X_{21}X_{22}X_{23}X_{24}X_{25}X_{26}X_{27}X_{28}X_{29}X_{30}$ | 2116 |

TABLE 10-continued

| Column 1 Nucleotide Sequence of Target Site in HNF4α Expression Control Region | Column 2 Target sequence with space | Column 3 Target sequence (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| tgagtgccc gtgagtcat gat | TGA gtg CCC AGT CAT GAT | 1019 | LEPGEKPYKCPECGKSFSTSGNL VRHQRTHTGEKPYKCPECGKSFS TSGNLTEHQRTHTGEKPYKCPEC GKSFSHRTTLTNHQRTHTGEKPY KCPECGKSFSRSDELVRHQRTHT GEKPYKCPECGKSSKKHLAEH QRTHTGEKPYKCPECGKSFSRSD ELVRHQRTHTGEKPYKCPECGKS FSQAGHLASHQRTHTGEKPTGKK TS | 1568 | $X_1X_2X_3X_4X_5X_6X_7X_8X_9CX_{10}X_{11}CX_{12}X_{13}X_{14}X_{15}X_{16}TSGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}HRTTLTNHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}QAGHLASHX_{17}X_{18}X_{19}HX_{20}X_{21}X_{22}X_{23}X_{24}X_{25}X_{26}X_{27}X_{28}X_{29}X_{30}$ | 2117 |
| gtgccgtg agtcatgat gcc | gtg CCC gtg AGT CAT GAT GCC | 1020 | LEPGEKPYKCPECGKSFSDCRDL ARHQRTHTGEKPYKCPECGKSFS TSGNLVRHQRTHTGEKPYKCPEC GKSFSTSGNLTEHQRTHTGEKPY KCPECGKSFSHRTTLTNHQRTHT GEKPYKCPECGKSFSRSDELVRH QRTHTGEKPYKCPECGKSFSSKK HLAEHQRTHTGEKPYKCPECGKS FSRSDELVRHQRTHTGEKPTGKK TS | 1569 | $X_1X_2X_3X_4X_5X_6X_7X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}HRTTLTNHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_{25}X_{26}X_{27}X_{28}X_{29}X_{30}$ | 2118 |
| ccgtgagtc atgatgcct gcc | CCG TGA GTC ATG ATG CCT GCC | 1021 | LEPGEKPYKCPECGKSFSDCRDL ARHQRTHTGEKPYKCPECGKSFS TKNSLTEHQRTHTGEKPYKCPEC GKSFSRRDELNVHQRTHTGEKPY KCPECGKSFSRRDELNVHQRTHT GEKPYKCPECGKSFSDPGALVRH QRTHTGEKPYKCPECGKSFSQAG HLASHQRTHTGEKPYKCPECGKS FSRNDTLTEHQRTHTGEKPTGKK TS | 1570 | $X_1X_2X_3X_4X_5X_6X_7X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}RRDELNVHX_{17}X_{18}X_{19}HX_{20}X_{21}X_{22}X_{23}X_{24}X_8X_9CX_{10}X_{11}CX_{12}X_{13}X_{14}X_{15}X_{16}RRDELNVHX_{17}X_{18}X_{19}HX_{20}X_{21}X_{22}X_{23}X_{24}X_8X_9CX_{10}X_{11}CX_{12}X_{13}X_{14}X_{15}X_{16}DPGALVRHX_{17}X_{18}X_{19}HX_{20}X_{21}X_{22}X_{23}X_{24}X_8X_9CX_{10}X_{11}CX_{12}X_{13}X_{14}X_{15}X_{16}QAGHLASHX_{17}X_{18}X_{19}HX_{20}X_{21}X_{22}X_{23}X_{24}X_8X_9CX_{10}X_{11}CX_{12}X_{13}X_{14}X_{15}X_{16}RNDTLTEHX_{17}X_{18}X_{19}HX_{20}X_{21}X_{22}X_{23}X_{24}X_{25}X_{26}X_{27}X_{28}X_{29}X_{30}$ | 2119 |
| gtcagccag aaccaaca aac | GTC AGC CAG AAA CCA ACA AAC | 1022 | LEPGEKPYKCPECGKSFSDSGNL RVHQRTHTGEKPYKCPECGKSFS SPADLTRHQRTHTGEKPYKCPEC GKSFSTSHSLTEHQRTHTGEKPY KCPECGKSFSQRANLRAHQRTHT GEKPYKCPECGKSFSRADNLTEH QRTHTGEKPYKCPECGKSFSERS HLREHQRTHTGEKPYKCPECGKS FSDPGALVRHQRTHTGEKPTGKK TS | 1571 | $X_1X_2X_3X_4X_5X_6X_7X_8X_9CX_{10}X_{11}CX_{12}X_{13}X_{14}X_{15}X_{16}DSGNLRVHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}QRANLRAHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}ERSHLREHX_{17}X_{18}X_{19}HX_{20}X_{21}X_{22}X_{23}X_{24}X_8X_9CX_{10}X_{11}CX_{12}X_{13}X_{14}X_{15}X_{16}DPGALVRHX_{17}X_{18}X_{19}HX_{20}X_{21}X_{22}X_{23}X_{24}X_{25}X_{26}X_{27}X_{28}X_{29}X_{30}$ | 2120 |

TABLE 10-continued

| Column 1 Nucleotide Sequence of Target Site in HNF4α Expression Control Region | Column 2 Target sequence with space | Column 3 SEQ ID NO. (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| agccagaaaccaacaaacagc | AGC CAG AAA CCA ACA AAC AGC | 1023 | LEPGEKPYKCPECGKSFSERSHL REHQRTHTGEKPYKCPECGKSFS DSGNLRVHQRTHTGEKPYKCPEC GKSFSSPADLTRHQRTHTGEKPY KCPECGKSFSTSHSLTEHQRTHT GEKPYKCPECGKSFSQRANLRAH QRTHTGEKPYKCPECGKSFSRAD NLTEHQRTHTGEKPYKCPECGKS FSERSHLREHQRTHTGEKPTGKK TS | 1572 | $X_1X_2X_3X_4X_5X_6X_7X_8X_9CX_{10}X_{11}CX_{12}X_{13}X_{14}X_{15}X_{16}$ERSHLREH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$DSGNLRVH$X_{17}X_{18}$ X$_9$H$X_{20}X_{21}X_{22}X_{23}X_{24}X_8X_9CX_{10}X_{11}CX_{12}X_{13}X_{14}X_{15}X_{16}$SPADLTRH$X_{17}$ $X_{18}X_{19}$H$X_{20}X_{21}X_{22}X_{23}X_{24}X_8X_9CX_{10}X_{11}CX_{12}X_{13}X_{14}X_{15}X_{16}$TSHSLTEH $X_{17}X_{18}X_{19}$H$X_{20}X_{21}X_{22}X_{23}X_{24}X_8X_9CX_{10}X_{11}CX_{12}X_{13}X_{14}X_{15}X_{16}$QRANLR AH$X_{17}X_{18}X_{19}$H$X_{20}X_{21}X_{22}X_{23}X_{24}X_8X_9CX_{10}X_{11}CX_{12}X_{13}X_{14}X_{15}X_{16}$RADN LTEH$X_{17}X_{18}X_{19}$H$X_{20}X_{21}X_{22}X_{23}X_{24}X_8X_9CX_{10}X_{11}CX_{12}X_{13}X_{14}X_{15}X_{16}$ER SHLREH$X_{17}X_{18}X_{19}$H$X_{20}X_{21}X_{22}X_{23}X_{24}X_{25}X_{26}X_{27}X_{28}X_{29}X_{30}$ | 2121 |
| cagaaaccaacaaacagccaa | CAG AAA CCA ACA AAC AGC CAA | 1024 | LEPGEKPYKCPECGKSFSQSGNL TEHQRTHTGEKPYKCPECGKSFS ERSHLREHQRTHTGEKPYKCPEC GKSFSDSGNLRVHQRTHTGEKPY KCPECGKSFSSPADLTRHQRTHT GEKPYKCPECGKSFSTSHSLTEH QRTHTGEKPYKCPECGKSFSQRA NLRAHQRTHTGEKPYKCPECGKS FSRADNLTEHQRTHTGEKPTGKK TS | 1573 | $X_1X_2X_3X_4X_5X_6X_7X_8X_9CX_{10}X_{11}CX_{12}X_{13}X_{14}X_{15}X_{16}$QSGNLTEH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$ERSHLREH$X_{17}X_{18}$ X$_{19}$H$X_{20}X_{21}X_{22}X_{23}X_{24}X_8X_9CX_{10}X_{11}CX_{12}X_{13}X_{14}X_{15}X_{16}$DSGNLRVH$X_{17}$ $X_{18}X_{19}$H$X_{20}X_{21}X_{22}X_{23}X_{24}X_8X_9CX_{10}X_{11}CX_{12}X_{13}X_{14}X_{15}X_{16}$SPADLTRH $X_{17}X_{18}X_{19}$H$X_{20}X_{21}X_{22}X_{23}X_{24}X_8X_9CX_{10}X_{11}CX_{12}X_{13}X_{14}X_{15}X_{16}$TSHSLT EH$X_{17}X_{18}X_{19}$H$X_{20}X_{21}X_{22}X_{23}X_{24}X_8X_9CX_{10}X_{11}CX_{12}X_{13}X_{14}X_{15}X_{16}$QRAN LRAH$X_{17}X_{18}X_{19}$H$X_{20}X_{21}X_{22}X_{23}X_{24}X_8X_9CX_{10}X_{11}CX_{12}X_{13}X_{14}X_{15}X_{16}$RA DNLTEH$X_{17}X_{18}X_{19}$H$X_{20}X_{21}X_{22}X_{23}X_{24}X_{25}X_{26}X_{27}X_{28}X_{29}X_{30}$ | 2122 |
| gccccagcagttgtaattagc | GCC CCA GCA GTT GTA ATT AGC | 1025 | LEPGEKPYKCPECGKSFSERSHL REHQRTHTGEKPYKCPECGKSFS HKNALQNHQRTHTGEKPYKCPEC GKSFSQSSSLVRHQRTHTGEKPY KCPECGKSFSTSGSLVRHQRTHT GEKPYKCPECGKSFSQSGDLRRH QRTHTGEKPYKCPECGKSFSTSH SLTEHQRTHTGEKPYKCPECGKS FSDCRDLARHQRTHTGEKPTGKK TS | 1574 | $X_1X_2X_3X_4X_5X_6X_7X_8X_9CX_{10}X_{11}CX_{12}X_{13}X_{14}X_{15}X_{16}$ERSHLREH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$HKNALQNH$X_{17}X_{18}$ X$_{19}$H$X_{20}X_{21}X_{22}X_{23}X_{24}X_8X_9CX_{10}X_{11}CX_{12}X_{13}X_{14}X_{15}X_{16}$QSSSLVRH$X_{17}$ $X_{18}X_{19}$H$X_{20}X_{21}X_{22}X_{23}X_{24}X_8X_9CX_{10}X_{11}CX_{12}X_{13}X_{14}X_{15}X_{16}$TSGSLVRH $X_{17}X_{18}X_{19}$H$X_{20}X_{21}X_{22}X_{23}X_{24}X_8X_9CX_{10}X_{11}CX_{12}X_{13}X_{14}X_{15}X_{16}$QSGDLR RH$X_{17}X_{18}X_{19}$H$X_{20}X_{21}X_{22}X_{23}X_{24}X_8X_9CX_{10}X_{11}CX_{12}X_{13}X_{14}X_{15}X_{16}$TSHS LTEH$X_{17}X_{18}X_{19}$H$X_{20}X_{21}X_{22}X_{23}X_{24}X_8X_9CX_{10}X_{11}CX_{12}X_{13}X_{14}X_{15}X_{16}$DC RDLARH$X_{17}X_{18}X_{19}$H$X_{20}X_{21}X_{22}X_{23}X_{24}X_{25}X_{26}X_{27}X_{28}X_{29}X_3$ | 2123 |
| cggtgagttagggcccagca | CGG TGA GTT AGG GCC CCA GCA | 1026 | LEPGEKPYKCPECGKSFSQSGDL RRHQRTHTGEKPYKCPECGKSFS TSHSLTEHQRTHTGEKPYKCPEC GKSFSDCRDLARHQRTHTGEKPY KCPECGKSFSRSDHLTNHQRTHT GEKPYKCPECGKSFSTSGSLVRH QRTHTGEKPYKCPECGKSFSQAG HLASHQRTHTGEKPYKCPECGKS FSRSDKLTEHQRTHTGEKPTGKK TS | 1575 | $X_1X_2X_3X_4X_5X_6X_7X_8X_9CX_{10}X_{11}CX_{12}X_{13}X_{14}X_{15}X_{16}$QSGDLRRH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$TSHSLTEH$X_{17}X_{18}$ X$_{19}$H$X_{20}X_{21}X_{22}X_{23}X_{24}X_8X_9CX_{10}X_{11}CX_{12}X_{13}X_{14}X_{15}X_{16}$DCRDLARH$X_{17}$ $X_{18}X_{19}$H$X_{20}X_{21}X_{22}X_{23}X_{24}X_8X_9CX_{10}X_{11}CX_{12}X_{13}X_{14}X_{15}X_{16}$RSDHLTNH $X_{17}X_{18}X_{19}$H$X_{20}X_{21}X_{22}X_{23}X_{24}X_8X_9CX_{10}X_{11}CX_{12}X_{13}X_{14}X_{15}X_{16}$TSGSLV RH$X_{17}X_{18}X_{19}$H$X_{20}X_{21}X_{22}X_{23}X_{24}X_8X_9CX_{10}X_{11}CX_{12}X_{13}X_{14}X_{15}X_{16}$QAGH LASH$X_{17}X_{18}X_{19}$H$X_{20}X_{21}X_{22}X_{23}X_{24}X_8X_9CX_{10}X_{11}CX_{12}X_{13}X_{14}X_{15}X_{16}$RS DKLTEH$X_{17}X_{18}X_{19}$H$X_{20}X_{21}X_{22}X_{23}X_{24}X_{25}X_{26}X_{27}X_{28}X_{29}X_{30}$ | 2124 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| ggtgtcagccagaaaccaaca | 1027 | GGT GTC AGC CAG AAA CCA ACA | LEPGEKPYKCPECGKSFSSPADLTRHQRTHTGEKPYKCPECGKSFSTSHSLTEHQRTHTGEKPYKCPECGKSFSQRANLRAHQRTHTGEKPYKCPECGKSFSRADNLTEHQRTHTGEKPYKCPECGKSFSERSHLREHQRTHTGEKPYKCPECGKSFSDPGALVRHQRTHTGEKPYKCPECGKSFSTSGHLVRHQRTHTGEKPTGKKTS | 1576 | $X_1X_2X_3X_4X_5X_6X_7X_8X_9CX_{10}X_{11}CX_{12}X_{13}X_{14}X_{15}X_{16}$SPADLTRH$X_{17}X_{18}X_{19}$H$X_{20}X_{21}X_{22}X_{23}X_{24}X_8X_9CX_{10}X_{11}CX_{12}X_{13}X_{14}X_{15}X_{16}$TSHSLTEH$X_{17}X_{18}$$X_{19}$H$X_{20}X_{21}X_{22}X_{23}X_{24}X_8X_9CX_{10}X_{11}CX_{12}X_{13}X_{14}X_{15}X_{16}$QRANLRAH$X_{17}$$X_{18}X_{19}$H$X_{20}X_{21}X_{22}X_{23}X_{24}X_8X_9CX_{10}X_{11}CX_{12}X_{13}X_{14}X_{15}X_{16}$RADNLTEH$X_{17}X_{18}X_{19}$H$X_{20}X_{21}X_{22}X_{23}X_{24}X_8X_9CX_{10}X_{11}CX_{12}X_{13}X_{14}X_{15}X_{16}$ERSHLREH$X_{17}X_{18}X_{19}$H$X_{20}X_{21}X_{22}X_{23}X_{24}X_8X_9CX_{10}X_{11}CX_{12}X_{13}X_{14}X_{15}X_{16}$DPGALVRH$X_{17}X_{18}X_{19}$H$X_{20}X_{21}X_{22}X_{23}X_{24}X_{25}X_{26}X_{27}X_{28}X_{29}X_{30}$GHLVRH$X_{17}X_{18}X_{19}$H$X_{20}X_{21}X_{22}X_{23}X_{24}X_{25}X_{26}X_{27}X_{28}X_{29}X_{30}$ | 2125 |
| agggcccagcagttgtaatt | 1028 | AGG GCC CCA GCA GTT GTA ATT | LEPGEKPYKCPECGKSFSHKNALQNHQRTHTGEKPYKCPECGKSFSQSSLVRHQRTHTGEKPYKCPECGKSFSTSGSLVRHQRTHTGEKPYKCPECGKSFSQSGDLRRHQRTHTGEKPYKCPECGKSFSTSHSLTEHQRTHTGEKPYKCPECGKSFSDCRDLARHQRTHTGEKPYKCPECGKSFSRSDHLTNHQRTHTGEKPTGKKTS | 1577 | $X_1X_2X_3X_4X_5X_6X_7X_8X_9CX_{10}X_{11}CX_{12}X_{13}X_{14}X_{15}X_{16}$HKNALQNH$X_{17}X_{18}X_{19}$H$X_{20}X_{21}X_{22}X_{23}X_{24}X_8X_9CX_{10}X_{11}CX_{12}X_{13}X_{14}X_{15}X_{16}$QSSLVRH$X_{17}X_{18}$$X_{19}$H$X_{20}X_{21}X_{22}X_{23}X_{24}X_8X_9CX_{10}X_{11}CX_{12}X_{13}X_{14}X_{15}X_{16}$TSGSLVRH$X_{17}$$X_{18}X_{19}$H$X_{20}X_{21}X_{22}X_{23}X_{24}X_8X_9CX_{10}X_{11}CX_{12}X_{13}X_{14}X_{15}X_{16}$QSGDLRRH$X_{17}X_{18}X_{19}$H$X_{20}X_{21}X_{22}X_{23}X_{24}X_8X_9CX_{10}X_{11}CX_{12}X_{13}X_{14}X_{15}X_{16}$TSHSLTEH$X_{17}X_{18}X_{19}$H$X_{20}X_{21}X_{22}X_{23}X_{24}X_8X_9CX_{10}X_{11}CX_{12}X_{13}X_{14}X_{15}X_{16}$DCRDLARH$X_{17}X_{18}X_{19}$H$X_{20}X_{21}X_{22}X_{23}X_{24}X_{25}X_{26}X_{27}X_{28}X_{29}X_{30}$DHLTNH$X_{17}X_{18}X_{19}$H$X_{20}X_{21}X_{22}X_{23}X_{24}X_{25}X_{26}X_{27}X_{28}X_{29}X_{30}$ | 2126 |
| ccagcagttgtaattagcacc | 1029 | CCA GCA GTT GTA ATT AGC ACC | LEPGEKPYKCPECGKSFSDKKDLTRHQRTHTGEKPYKCPECGKSFSERSHLREHQRTHTGEKPYKCPECGKSFSHKNALQNHQRTHTGEKPYKCPECGKSFSQSSLVRHQRTHTGEKPYKCPECGKSFSTSGSLVRHQRTHTGEKPYKCPECGKSFSQSGDLRRHQRTHTGEKPYKCPECGKSFSTSHSLTEHQRTHTGEKPTGKKTS | 1578 | $X_1X_2X_3X_4X_5X_6X_7X_8X_9CX_{10}X_{11}CX_{12}X_{13}X_{14}X_{15}X_{16}$DKKDLTRH$X_{17}X_{18}X_{19}$H$X_{20}X_{21}X_{22}X_{23}X_{24}X_8X_9CX_{10}X_{11}CX_{12}X_{13}X_{14}X_{15}X_{16}$ERSHLREH$X_{17}X_{18}$$X_{19}$H$X_{20}X_{21}X_{22}X_{23}X_{24}X_8X_9CX_{10}X_{11}CX_{12}X_{13}X_{14}X_{15}X_{16}$HKNALQNH$X_{17}$$X_{18}X_{19}$H$X_{20}X_{21}X_{22}X_{23}X_{24}X_8X_9CX_{10}X_{11}CX_{12}X_{13}X_{14}X_{15}X_{16}$QSSLVRH$X_{17}X_{18}X_{19}$H$X_{20}X_{21}X_{22}X_{23}X_{24}X_8X_9CX_{10}X_{11}CX_{12}X_{13}X_{14}X_{15}X_{16}$TSGSLVRH$X_{17}X_{18}X_{19}$H$X_{20}X_{21}X_{22}X_{23}X_{24}X_8X_9CX_{10}X_{11}CX_{12}X_{13}X_{14}X_{15}X_{16}$QSGDLRRH$X_{17}X_{18}X_{19}$H$X_{20}X_{21}X_{22}X_{23}X_{24}X_{25}X_{26}X_{27}X_{28}X_{29}X_{30}$HSLTEH$X_{17}X_{18}X_{19}$H$X_{20}X_{21}X_{22}X_{23}X_{24}X_{25}X_{26}X_{27}X_{28}X_{29}X_{30}$ | 2127 |
| ataactgaacatcggtgagtt | 1030 | ATA ACT GAA CAT CGG TGA GTT | LEPGEKPYKCPECGKSFSTSGSLVRHQRTHTGEKPYKCPECGKSFSQAGHLASHQRTHTGEKPYKCPECGKSFSRSDKLTEHQRTHTGEKPYKCPECGKSFSTSGNLTEHQRTHTGEKPYKCPECGKSFSQSSNLVRHQRTHTGEKPYKCPECGKSFSTHLDLIRHQRTHTGEKPYKCPECGKSFSQKSSLIAHQRTHTGEKPTGKKTS | 1579 | $X_1X_2X_3X_4X_5X_6X_7X_8X_9CX_{10}X_{11}CX_{12}X_{13}X_{14}X_{15}X_{16}$TSGSLVRH$X_{17}X_{18}X_{19}$H$X_{20}X_{21}X_{22}X_{23}X_{24}X_8X_9CX_{10}X_{11}CX_{12}X_{13}X_{14}X_{15}X_{16}$QAGHLASH$X_{17}X_{18}$$X_{19}$H$X_{20}X_{21}X_{22}X_{23}X_{24}X_8X_9CX_{10}X_{11}CX_{12}X_{13}X_{14}X_{15}X_{16}$RSDKLTEH$X_{17}$$X_{18}X_{19}$H$X_{20}X_{21}X_{22}X_{23}X_{24}X_8X_9CX_{10}X_{11}CX_{12}X_{13}X_{14}X_{15}X_{16}$TSGNLTEH$X_{17}X_{18}X_{19}$H$X_{20}X_{21}X_{22}X_{23}X_{24}X_8X_9CX_{10}X_{11}CX_{12}X_{13}X_{14}X_{15}X_{16}$QSSNLVRH$X_{17}X_{18}X_{19}$H$X_{20}X_{21}X_{22}X_{23}X_{24}X_8X_9CX_{10}X_{11}CX_{12}X_{13}X_{14}X_{15}X_{16}$THLDLIRH$X_{17}X_{18}X_{19}$H$X_{20}X_{21}X_{22}X_{23}X_{24}X_{25}X_{26}X_{27}X_{28}X_{29}X_{30}$SSLIAH$X_{17}X_{18}X_{19}$H$X_{20}X_{21}X_{22}X_{23}X_{24}X_{25}X_{26}X_{27}X_{28}X_{29}X_{30}$ | 2128 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| catcggtga gttaggcc cca | 1031 | CAT CGG TGA GTT AGG GCC CCA | LEPGEKPYKCPECGKSFSTSHSL TEHQRTHTGEKPYKCPECGKSFS DCRDLARHQRTHTGEKPYKCPEC GKSFSRSDHLTNHQRTHTGEKPY KCPECGKSFSTSGSLVRHQRTHT GEKPYKCPECGKSFSQAGHLASH QRTHTGEKPYKCPECGKSFSRSD KLTEHQRTHTGEKPYKCPECGKS FSTSGNLTEHQRTHTGEKPTGKK TS | 1580 | $X_1X_2X_3X_4X_5X_6X_7X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}TSGSLVRH X_{17}X_{18}X_{19}HX_{20}X_{21}X_{22}X_{23}X_{24}X_8X_9CX_{10}X_{11}CX_{12}X_{13}X_{14}X_{15}X_{16}QAGHLA SHX_{17}X_{18}X_{19}HX_{20}X_{21}X_{22}X_{23}X_{24}X_8X_9CX_{10}X_{11}CX_{12}X_{13}X_{14}X_{15}X_{16}RSDK LTEHX_{17}X_{18}X_{19}HX_{20}X_{21}X_{22}X_{23}X_{24}X_8X_9CX_{10}X_{11}CX_{12}X_{13}X_{14}X_{15}X_{16}TS GNLTEHX_{17}X_{18}X_{19}HX_{20}X_{21}X_{22}X_{23}X_{24}X_{25}X_{26}X_{27}X_{28}X_{29}X_{30}$ | 2129 |
| ccgggtgtc agcagaaa cca | 122 | CCG GGT GTC AGC AGA AAA CCA | LEPGEKPYKCPECGKSFSTSHSL TEHQRTHTGEKPYKCPECGKSFS QRANLRAHQRTHTGEKPYKCPEC GKSFSRADNLTEHQRTHTGEKPY KCPECGKSFSERSHLREHQRTHT GEKPYKCPECGKSFSDPGALVRH QRTHTGEKPYKCPECGKSFSTSG HLVRHQRTHTGEKPYKCPECGKS FSRNDTLTEHQRTHTGEKPTGKK TS | 123 | $X_1X_2X_3X_4X_5X_6X_7X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}QRANLRAHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}ERSHLREH X_{17}X_{18}X_{19}HX_{20}X_{21}X_{22}X_{23}X_{24}X_8X_9CX_{10}X_{11}CX_{12}X_{13}X_{14}X_{15}X_{16}DPGALV RHX_{17}X_{18}X_{19}HX_{20}X_{21}X_{22}X_{23}X_{24}X_8X_9CX_{10}X_{11}CX_{12}X_{13}X_{14}X_{15}X_{16}TSGH LVRHX_{17}X_{18}X_{19}HX_{20}X_{21}X_{22}X_{23}X_{24}X_8X_9CX_{10}X_{11}CX_{12}X_{13}X_{14}X_{15}X_{16}RN DTLTEHX_{17}X_{18}X_{19}HX_{20}X_{21}X_{22}X_{23}X_{24}X_{25}X_{26}X_{27}X_{28}X_{29}X_{30}$ | 318 |
| actgaacat cggtgagtt agg | 126 | ACT GAA CAT CGG TGA GTT AGG | LEPGEKPYKCPECGKSFSRSDHL TNHQRTHTGEKPYKCPECGKSFS TSGSLVRHQRTHTGEKPYKCPEC GKSFSQAGHLASHQRTHTGEKPY KCPECGKSFSRSDKLTEHQRTHT GEKPYKCPECGKSFSTSGNLTEH QRTHTGEKPYKCPECGKSFSQSS NLVRHQRTHTGEKPYKCPECGKS FSTHLDLIRHQRTHTGEKPTGKK TS | 127 | $X_1X_2X_3X_4X_5X_6X_7X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}TSGSLVRHX_{17}X_{18}X_{19}HX_{20}X_{21}X_{22}X_{23}X_{24}X_8X_9CX_{10}X_{11}CX_{12}X_{13}X_{14}X_{15}X_{16}QAGHLASHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLTEH X_{17}X_{18}X_{19}HX_{20}X_{21}X_{22}X_{23}X_{24}X_8X_9CX_{10}X_{11}CX_{12}X_{13}X_{14}X_{15}X_{16}TSGNLT EHX_{17}X_{18}X_{19}HX_{20}X_{21}X_{22}X_{23}X_{24}X_8X_9CX_{10}X_{11}CX_{12}X_{13}X_{14}X_{15}X_{16}QSSN LVRHX_{17}X_{18}X_{19}HX_{20}X_{21}X_{22}X_{23}X_{24}X_8X_9CX_{10}X_{11}CX_{12}X_{13}X_{14}X_{15}X_{16}TH LDLIRHX_{17}X_{18}X_{19}HX_{20}X_{21}X_{22}X_{23}X_{24}X_{25}X_{26}X_{27}X_{28}X_{29}X_{30}$ | 319 |
| gaacatcgg tgagttagg gcc | 1032 | GAA CAT CGG TGA GTT AGG GCC | LEPGEKPYKCPECGKSFSDCRDL ARHQRTHTGEKPYKCPECGKSFS RSDHLTNHQRTHTGEKPYKCPEC GKSFSTSGSLVRHQRTHTGEKPY KCPECGKSFSQAGHLASHQRTHT GEKPYKCPECGKSFSRSDKLTEH QRTHTGEKPYKCPECGKSFSTSG NLTEHQRTHTGEKPYKCPECGKS FSQSSNLVRHQRTHTGEKPTGKK TS | 1581 | $X_1X_2X_3X_4X_5X_6X_7X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}TSGSLVRHX_{17}X_{18}X_{19}HX_{20}X_{21}X_{22}X_{23}X_{24}X_8X_9CX_{10}X_{11}CX_{12}X_{13}X_{14}X_{15}X_{16}QAGHLASH X_{17}X_{18}X_{19}HX_{20}X_{21}X_{22}X_{23}X_{24}X_8X_9CX_{10}X_{11}CX_{12}X_{13}X_{14}X_{15}X_{16}RSDKLT EHX_{17}X_{18}X_{19}HX_{20}X_{21}X_{22}X_{23}X_{24}X_8X_9CX_{10}X_{11}CX_{12}X_{13}X_{14}X_{15}X_{16}TSGN LTEHX_{17}X_{18}X_{19}HX_{20}X_{21}X_{22}X_{23}X_{24}X_8X_9CX_{10}X_{11}CX_{12}X_{13}X_{14}X_{15}X_{16}QS SNLVRHX_{17}X_{18}X_{19}HX_{20}X_{21}X_{22}X_{23}X_{24}X_{25}X_{26}X_{27}X_{28}X_{29}X_{30}$ | 2130 |

TABLE 10-continued

| Column 1 Nucleotide Sequence of Target Site in HNF4α Expression Control Region | Column 2 Target sequence with space | Column 3 Column 4 (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| acccgggt gtcagccag aaa | ACC CCG GGT GTC AGC CAG AAA | 1033 | LEPGEKPYKCPECGKSFSQRANL RAHQRTHTGEKPYKCPECGKSFS RADNLTEHQRTHTGEKPYKCPEC GKSFSERSHLREHQRTHTGEKPY KCPECGKSFSDPGALVRHQRTHT GEKPYKCPECGKSFSTSGHLVRH QRTHTGEKPYKCPECGKSFSRND TLTEHQRTHTGEKPYKCPECGKS FSDKKDLTRHQRTHTGEKPTGKK TS | 1582 | $X_1X_2X_3X_4X_5X_6X_7X_8X_9CX_{10}X_{11}CX_{12}X_{13}X_{14}X_{15}X_{16}QRANLRAHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}ERSHLREHX_{17}X_{18}X_{19}HX_{20}X_{21}X_{22}X_{23}X_{24}X_8X_9CX_{10}X_{11}CX_{12}X_{13}X_{14}X_{15}X_{16}DPGALVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RNDTLTEHX_{17}X_{18}X_{19}HX_9HX_{20}X_{21}X_{22}X_{23}X_{24}X_8X_9CX_{10}X_{11}CX_{12}X_{13}X_{14}X_{15}X_{16}DKDLTRHX_{17}X_{18}X_{19}HX_{20}X_{21}X_{22}X_{23}X_{24}X_{25}X_{26}X_{27}X_{28}X_{29}X_{30}$ | 2131 |
| agcaccccg ggtgtcagc cag | AGC ACC CCG GGT GTC AGC CAG | 1034 | LEPGEKPYKCPECGKSFSRADNL TEHQRTHTGEKPYKCPECGKSFS ERSHLREHQRTHTGEKPYKCPEC GKSFSDPGALVRHQRTHTGEKPY KCPECGKSFSTSGHLVRHQRTHT GEKPYKCPECGKSFSRNDTLTEH QRTHTGEKPYKCPECGKSFSDKK DLTRHQRTHTGEKPYKCPECGKS FSERSHLREHQRTHTGEKPTGKK TS | 1583 | $X_1X_2X_3X_4X_5X_6X_7X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}ERSHLREHX_{17}X_{18}X_{19}HX_{20}X_{21}X_{22}X_{23}X_{24}X_8X_9CX_{10}X_{11}CX_{12}X_{13}X_{14}X_{15}X_{16}DPGALVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RNDTLTEHX_{17}X_{18}X_{19}HX_{20}X_{21}X_{22}X_{23}X_{24}X_8X_9CX_{10}X_{11}CX_{12}X_{13}X_{14}X_{15}X_{16}DKKDLTRHX_{17}X_{18}X_{19}HX_{20}X_{21}X_{22}X_{23}X_{24}X_8X_9CX_{10}X_{11}CX_{12}X_{13}X_{14}X_{15}X_{16}ERSHLREHX_{17}X_{18}X_{19}HX_{20}X_{21}X_{22}X_{23}X_{24}X_{25}X_{26}X_{27}X_{28}X_{29}X_{30}$ | 2132 |
| gcagttgta attagcacc ccg | GCA GTT GTA ATT AGC ACC CCG | 1035 | LEPGEKPYKCPECGKSFSRNDTL TEHQRTHTGEKPYKCPECGKSFS DKKDLTRHQRTHTGEKPYKCPEC GKSFSERSHLREHQRTHTGEKPY KCPECGKSFSHKNALQNHQRTHT GEKPYKCPECGKSFSQSSSLVRH QRTHTGEKPYKCPECGKSFSTSG SLVRHQRTHTGEKPYKCPECGKS FSQSGDLRRHQRTHTGEKPTGKK TS | 1584 | $X_1X_2X_3X_4X_5X_6X_7X_8X_9CX_{10}X_{11}CX_{12}X_{13}X_{14}X_{15}X_{16}RNDTLTEHX_{17}X_{18}X_{19}HX_{20}X_{21}X_{22}X_{23}X_{24}X_8X_9CX_{10}X_{11}CX_{12}X_{13}X_{14}X_{15}X_{16}DKKDLTRHX_{17}X_{18}X_{19}HX_{20}X_{21}X_{22}X_{23}X_{24}X_8X_9CX_{10}X_{11}CX_{12}X_{13}X_{14}X_{15}X_{16}ERSHLREHX_{17}X_{18}X_{19}HX_{20}X_{21}X_{22}X_{23}X_{24}X_8X_9CX_{10}X_{11}CX_{12}X_{13}X_{14}X_{15}X_{16}HKNALQNHX_{17}X_{18}X_{19}HX_{20}X_{21}X_{22}X_{23}X_{24}X_8X_9CX_{10}X_{11}CX_{12}X_{13}X_{14}X_{15}X_{16}QSSSLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGSLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_{25}X_{26}X_{27}X_{28}X_{29}X_{30}$ | 2133 |
| attagcacc ccgggtgtc agc | ATT AGC ACC CCG GGT GTC AGC | 1036 | LEPGEKPYKCPECGKSFSERSHL REHQRTHTGEKPYKCPECGKSFS DPGALVRHQRTHTGEKPYKCPEC GKSFSTSGHLVRHQRTHTGEKPY KCPECGKSFSRNDTLTEHQRTHT GEKPYKCPECGKSFSDKKDLTRH QRTHTGEKPYKCPECGKSFSERS HLREHQRTHTGEKPYKCPECGKS FSHKNALQNHQRTHTGEKPTGKK TS | 1585 | $X_1X_2X_3X_4X_5X_6X_7X_8X_9CX_{10}X_{11}CX_{12}X_{13}X_{14}X_{15}X_{16}ERSHLREHX_{17}X_{18}X_{19}HX_{20}X_{21}X_{22}X_{23}X_{24}X_8X_9CX_{10}X_{11}CX_{12}X_{13}X_{14}X_{15}X_{16}DPGALVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RNDTLTEHX_{17}X_{18}X_{19}HX_{20}X_{21}X_{22}X_{23}X_{24}X_8X_9CX_{10}X_{11}CX_{12}X_{13}X_{14}X_{15}X_{16}DKKDLTRHX_{17}X_{18}X_{19}HX_{20}X_{21}X_{22}X_{23}X_{24}X_8X_9CX_{10}X_{11}CX_{12}X_{13}X_{14}X_{15}X_{16}ERSHLREHX_{17}X_{18}X_{19}HX_{20}X_{21}X_{22}X_{23}X_{24}X_8X_9CX_{10}X_{11}CX_{12}X_{13}X_{14}X_{15}X_{16}HKNALQNHX_{17}X_{18}X_{19}HX_{20}X_{21}X_{22}X_{23}X_{24}X_{25}X_{26}X_{27}X_{28}X_{29}X_{30}$ | 2134 |

TABLE 10-continued

| Column 1 Nucleotide Sequence of Target Site in HNF4α Expression Control Region | Column 2 Column 3 Target sequence with space | Column 3 Target sequence with space | Column 4 Amino acid Sequence of Zinc Finger DNA Binding Domain Polypeptides Targeting the Target Site in Column 1 | Column 5 SEQ ID NO. (corresponds to sequences in Columns 2 and 3) | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gtaattagc acccgggt gtc | GTA ATT AGC ACC CCG GGT GTC | 1037 | LEPGEKPYKCPECGKSFSDPGAL VRHQRTHTGEKPYKCPECGKSFS TSGHLVRHQRTHTGEKPYKCPEC GKSFSRNDTLTEHQRTHTGEKPY KCPECGKSFSDKKDLTRHQRTHT GEKPYKCPECGKSFSERSHLREH QRTHTGEKPYKCPECGKSFSHKN ALQNHQRTHTGEKPYKCPECGKS FSQSSLVRHQRTHTGEKPTGKK TS | 1586 | $X_1X_2X_3X_4X_5X_6X_7X_8X_9CX_{10}X_{11}CX_{12}X_{13}X_{14}X_{15}X_{16}DPGALVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RNDTLTEHX_{17}X_{18}X_{19}HX_{20}X_{21}X_{22}X_{23}X_{24}X_8X_9CX_{10}X_{11}CX_{12}X_{13}X_{14}X_{15}X_{16}DKKDLTRHX_{17}X_{18}X_{19}HX_{20}X_{21}X_{22}X_{23}X_{24}X_8X_9CX_{10}X_{11}CX_{12}X_{13}X_{14}X_{15}X_{16}ERSHLREHX_{17}X_{18}X_{19}HX_{20}X_{21}X_{22}X_{23}X_{24}X_8X_9CX_{10}X_{11}CX_{12}X_{13}X_{14}X_{15}X_{16}HKNALQNHX_{17}X_{18}X_{19}HX_{20}X_{21}X_{22}X_{23}X_{24}X_{25}X_{26}X_{27}X_{28}X_{29}X_{30}SSLVRHX_{17}X_{18}X_{19}HX_{20}X_{21}X_{22}X_{23}X_{24}X_{25}X_{26}X_{27}X_{28}X_{29}X_{30}$ | 2135 |
| tgagttagg gcccagca gtt | TGA GTT AGG GCC CAG CA GTT | 1038 | LEPGEKPYKCPECGKSFSTSGSL VRHQRTHTGEKPYKCPECGKSFS QSGDLRRHQRTHTGEKPYKCPEC GKSFSTSHSLTEHQRTHTGEKPY KCPECGKSFSDCRDLARHQRTHT GEKPYKCPECGKSFSRSDHLTNH QRTHTGEKPYKCPECGKSFSTSG SLVRHQRTHTGEKPYKCPECGKS FSQAGHLASHQRTHTGEKPTGKK TS | 1587 | $X_1X_2X_3X_4X_5X_6X_7X_8X_9CX_{10}X_{11}CX_{12}X_{13}X_{14}X_{15}X_{16}TSGSLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}TSGSLVRHX_{17}X_{18}X_{19}HX_{20}X_{21}X_{22}X_{23}X_{24}X_{25}X_{26}X_{27}X_{28}X_{29}X_{30}QAGHLASHX_{17}X_{18}X_{19}HX_{20}X_{21}X_{22}X_{23}X_{24}X_{25}X_{26}X_{27}X_{28}X_{29}X_{30}$ | 2136 |
| gttagggcc ccagcagtt gta | GTT AGG GCC CCA GCA GTT GTA | 1039 | LEPGEKPYKCPECGKSFSQSSSL VRHQRTHTGEKPYKCPECGKSFS TSGSLVRHQRTHTGEKPYKCPEC GKSFSQSGDLRRHQRTHTGEKPY KCPECGKSFSTSHSLTEHQRTHT GEKPYKCPECGKSFSDCRDLARH QRTHTGEKPYKCPECGKSFSRSD HLTNHQRTHTGEKPYKCPECGKS FSTSGSLVRHQRTHTGEKPTGKK TS | 1588 | $X_1X_2X_3X_4X_5X_6X_7X_8X_9CX_{10}X_{11}CX_{12}X_{13}X_{14}X_{15}X_{16}QSSSLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGSLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_{25}X_{26}X_{27}X_{28}X_{29}X_{30}TSGSLVRHX_{17}X_{18}X_{19}HX_{20}X_{21}X_{22}X_{23}X_{24}X_{25}X_{26}X_{27}X_{28}X_{29}X_{30}$ | 2137 |
| gttgtaatt agcaccccg ggt | GTT GTA ATT AGC ACC CCG GGT | 1040 | LEPGEKPYKCPECGKSFSTSGHL VRHQRTHTGEKPYKCPECGKSFS RNDTLTEHQRTHTGEKPYKCPEC GKSFSDKKDLTRHQRTHTGEKPY KCPECGKSFSERSHLREHQRTHT GEKPYKCPECGKSFSHKNALQNH QRTHTGEKPYKCPECGKSFSQSS SLVRHQRTHTGEKPYKCPECGKS FSTSGSLVRHQRTHTGEKPTGKK TS | 1589 | $X_1X_2X_3X_4X_5X_6X_7X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RNDTLTEHX_{17}X_{18}X_{19}HX_{20}X_{21}X_{22}X_{23}X_{24}X_8X_9CX_{10}X_{11}CX_{12}X_{13}X_{14}X_{15}X_{16}DKKDLTRHX_{17}X_{18}X_{19}HX_{20}X_{21}X_{22}X_{23}X_{24}X_8X_9CX_{10}X_{11}CX_{12}X_{13}X_{14}X_{15}X_{16}ERSHLREHX_{17}X_{18}X_{19}HX_{20}X_{21}X_{22}X_{23}X_{24}X_8X_9CX_{10}X_{11}CX_{12}X_{13}X_{14}X_{15}X_{16}HKNALQNHX_{17}X_{18}X_{19}HX_{20}X_{21}X_{22}X_{23}X_{24}X_8X_9CX_{10}X_{11}CX_{12}X_{13}X_{14}X_{15}X_{16}QSSSLVRHX_{17}X_{18}X_{19}HX_{20}X_{21}X_{22}X_{23}X_{24}X_{25}X_{26}X_{27}X_{28}X_{29}X_{30}TSGSLVRHX_{17}X_{18}X_{19}HX_{20}X_{21}X_{22}X_{23}X_{24}X_{25}X_{26}X_{27}X_{28}X_{29}X_{30}$ | 2138 |

TABLE 10-continued

| Column 1 Nucleotide Sequence of Target Site in HNF4α Expression Control Region | Column 3 Target sequence with space | Column 2 SEQ ID NO. (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gtgagttag ggcccagc agt | gtg AGT TAG GGC CCC AGC AGT | 1041 | LEPGEKPYKCPECGKSFSHRTTL TNHQRTHTGEKPYKCPECGKSFS ERSHLREHQRTHTGEKPYKCPEC GKSFSSKKHLAEHQRTHTGEKPY KCPECGKSFSDPGHLVRHQRTHT GEKPYKCPECGKSFSREDNLHTH QRTHTGEKPYKCPECGKSFSHRT TLTNHQRTHTGEKPYKCPECGKS FSRSDELVRHQRTHTGEKPTGKK TS | 1590 | $X_1X_2X_3X_4X_5X_6X_7X_8X_9CX_{10}X_{11}CX_{12}X_{13}X_{14}X_{15}X_{16}HRTTLTNHX_{17}X_{18}X_{19}HX_{20}X_{21}X_{22}X_{23}X_{24}X_8X_9CX_{10}X_{11}CX_{12}X_{13}X_{14}X_{15}X_{16}ERSHLREHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}REDNLHTHX_{17}X_{18}X_{19}HX_{20}X_{21}X_{22}X_{23}X_{24}X_8X_9CX_{10}X_{11}CX_{12}X_{13}X_{14}X_{15}X_{16}HRTTLTNHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_{25}X_{26}X_{27}X_{28}X_{29}X_{30}$ | 2139 |
| cagccagaa accaacaaa cag | CAG CCA GAA ACC AAC AAA CAG | 1042 | LEPGEKPYKCPECGKSFSRADNL TEHQRTHTGEKPYKCPECGKSFS QRANLRAHQRTHTGEKPYKCPEC GKSFSDSGNLRVHQRTHTGEKPY KCPECGKSFSDKKDLTRHQRTHT GEKPYKCPECGKSFSQSSNLVRH QRTHTGEKPYKCPECGKSFSTSH SLTEHQRTHTGEKPYKCPECGKS FSRADNLTEHQRTHTGEKPTGKK TS | 1591 | $X_1X_2X_3X_4X_5X_6X_7X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}QRANLRAHX_{17}X_{18}X_{19}HX_{20}X_{21}X_{22}X_{23}X_{24}X_8X_9CX_{10}X_{11}CX_{12}X_{13}X_{14}X_{15}X_{16}DSGNLRVHX_{17}X_{18}X_{19}HX_{20}X_{21}X_{22}X_{23}X_{24}X_8X_9CX_{10}X_{11}CX_{12}X_{13}X_{14}X_{15}X_{16}DKKDLTRHX_{17}X_{18}X_{19}HX_{20}X_{21}X_{22}X_{23}X_{24}X_8X_9CX_{10}X_{11}CX_{12}X_{13}X_{14}X_{15}X_{16}QSSNLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_{25}X_{26}X_{27}X_{28}X_{29}X_{30}$ | 2140 |
| gaaaccaac aacagcca aat | GAA ACC AAC AAC AGC CCA AAT | 1043 | LEPGEKPYKCPECGKSFSTTGNL TVHQRTHTGEKPYKCPECGKSFS TSHSLTEHQRTHTGEKPYKCPEC GKSFSRADNLTEHQRTHTGEKPY KCPECGKSFSQRANLRAHQRTHT GEKPYKCPECGKSFSDSGNLRVH QRTHTGEKPYKCPECGKSFSDKK DLTRHQRTHTGEKPYKCPECGKS FSQSSNLVRHQRTHTGEKPTGKK TS | 1592 | $X_1X_2X_3X_4X_5X_6X_7X_8X_9CX_{10}X_{11}CX_{12}X_{13}X_{14}X_{15}X_{16}TTGNLTVHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}QRANLRAHX_{17}X_{18}X_{19}HX_{20}X_{21}X_{22}X_{23}X_{24}X_8X_9CX_{10}X_{11}CX_{12}X_{13}X_{14}X_{15}X_{16}DSGNLRVHX_{17}X_{18}X_{19}HX_{20}X_{21}X_{22}X_{23}X_{24}X_8X_9CX_{10}X_{11}CX_{12}X_{13}X_{14}X_{15}X_{16}DKKDLTRHX_{17}X_{18}X_{19}HX_{20}X_{21}X_{22}X_{23}X_{24}X_8X_9CX_{10}X_{11}CX_{12}X_{13}X_{14}X_{15}X_{16}QSSNLVRHX_{17}X_{18}X_{19}HX_{20}X_{21}X_{22}X_{23}X_{24}X_{25}X_{26}X_{27}X_{28}X_{29}X_{30}$ | 2141 |
| ccagaaacc aacaaacag cca | CCA GAA ACC AAC AAA CAG CCA | 1044 | LEPGEKPYKCPECGKSFSTSHSL TEHQRTHTGEKPYKCPECGKSFS RADNLTEHQRTHTGEKPYKCPEC GKSFSQRANLRAHQRTHTGEKPY KCPECGKSFSDSGNLRVHQRTHT GEKPYKCPECGKSFSDKKDLTRH QRTHTGEKPYKCPECGKSFSQSS NLVRHQRTHTGEKPYKCPECGKS FSTSHSLTEHQRTHTGEKPTGKK TS | 1593 | $X_1X_2X_3X_4X_5X_6X_7X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}QRANLRAHX_{17}X_{18}X_{19}HX_{20}X_{21}X_{22}X_{23}X_{24}X_8X_9CX_{10}X_{11}CX_{12}X_{13}X_{14}X_{15}X_{16}DSGNLRVHX_{17}X_{18}X_{19}HX_{20}X_{21}X_{22}X_{23}X_{24}X_8X_9CX_{10}X_{11}CX_{12}X_{13}X_{14}X_{15}X_{16}DKKDLTRHX_{17}X_{18}X_{19}HX_{20}X_{21}X_{22}X_{23}X_{24}X_8X_9CX_{10}X_{11}CX_{12}X_{13}X_{14}X_{15}X_{16}QSSNLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_{25}X_{26}X_{27}X_{28}X_{29}X_{30}$ | 2142 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| accaacaaa cagccaaat ccc | 1045 | ACC AAC AAA CAG CCA AAT CCC | LEPGEKPYKCPECGKSFSSKKHL AEHQRTHTGEKPYKCPECGKSFS TTGNLTVHQRTHTGEKPYKCPEC GKSFSTSHSLTEHQRTHTGEKPY KCPECGKSFSRADNLTEHQRTHT GEKPYKCPECGKSFSQRANLRAH QRTHTGEKPYKCPECGKSFSDSG NLRVHQRTHTGEKPYKCPECGKS FSDKKDLTRHQRTHTGEKPTGKK TS | 1594 | $X_1X_2X_3X_4X_5X_6X_7X_8X_9CX_{10}X_{11}CX_{12}X_{13}X_{14}X_{15}X_{16}$SKKHLAEH$X_{17}X_{18}X_{19}$H$X_{20}X_{21}X_{22}X_{23}X_{24}X_8X_9CX_{10}X_{11}CX_{12}X_{13}X_{14}X_{15}X_{16}$TTGNLTVH$X_{17}X_{18}$ $X_{19}HX_{20}X_{21}X_{22}X_{23}X_{24}X_8X_9CX_{10}X_{11}CX_{12}X_{13}X_{14}X_{15}X_{16}$TSHSLTEH$X_{17}$ $X_{18}X_{19}HX_{20}X_{21}X_{22}X_{23}X_{24}X_8X_9CX_{10}X_{11}CX_{12}X_{13}X_{14}X_{15}X_{16}$RADNLTEH $X_{17}X_{18}X_{19}HX_{20}X_{21}X_{22}X_{23}X_{24}X_8X_9CX_{10}X_{11}CX_{12}X_{13}X_{14}X_{15}X_{16}$QRANLR AH$X_{17}X_{18}X_{19}HX_{20}X_{21}X_{22}X_{23}X_{24}X_8X_9CX_{10}X_{11}CX_{12}X_{13}X_{14}X_{15}X_{16}$DSGN LRVH$X_{17}X_{18}X_{19}HX_{20}X_{21}X_{22}X_{23}X_{24}X_8X_9CX_{10}X_{11}CX_{12}X_{13}X_{14}X_{15}X_{16}$DK KDLTRH$X_{17}X_{18}X_{19}HX_{20}X_{21}X_{22}X_{23}X_{24}X_{25}X_{26}X_{27}X_{28}X_{29}X_{30}$ | 2143 |
| gccagaaac caacaaaca gcc | 1046 | GCC AGA AAC CAA CAA ACA GCC | LEPGEKPYKCPECGKSFSDCRDL ARHQRTHTGEKPYKCPECGKSFS SPADLTRHQRTHTGEKPYKCPEC GKSFSQSGNLTEHQRTHTGEKPY KCPECGKSFSDSGNLRVH QRTHTGEKPYKCPECGKSFSQLA HLRAHQRTHTGEKPYKCPECGKS FSDCRDLARHQRTHTGEKPTGKK TS | 1595 | $X_1X_2X_3X_4X_5X_6X_7X_8X_9CX_{10}X_{11}CX_{12}X_{13}X_{14}X_{15}X_{16}$DCRDLARH$X_{17}X_{18}X_{19}$H$X_{20}X_{21}X_{22}X_{23}X_{24}X_8X_9CX_{10}X_{11}CX_{12}X_{13}X_{14}X_{15}X_{16}$SPADLTRH$X_{17}X_{18}$ $X_{19}HX_{20}X_{21}X_{22}X_{23}X_{24}X_8X_9CX_{10}X_{11}CX_{12}X_{13}X_{14}X_{15}X_{16}$QSGNLTEH$X_{17}$ $X_{18}X_{19}HX_{20}X_{21}X_{22}X_{23}X_{24}X_8X_9CX_{10}X_{11}CX_{12}X_{13}X_{14}X_{15}X_{16}$DSGNLR VH$X_{17}X_{18}X_{19}HX_{20}X_{21}X_{22}X_{23}X_{24}X_8X_9CX_{10}X_{11}CX_{12}X_{13}X_{14}X_{15}X_{16}$QLAH LRAH$X_{17}X_{18}X_{19}HX_{20}X_{21}X_{22}X_{23}X_{24}X_8X_9CX_{10}X_{11}CX_{12}X_{13}X_{14}X_{15}X_{16}$DC RDLARH$X_{17}X_{18}X_{19}HX_{20}X_{21}X_{22}X_{23}X_{24}X_{25}X_{26}X_{27}X_{28}X_{29}X_{30}$ | 2144 |
| agaaccaa caacagcc aaa | 1047 | AGA AAC CAA CAA CAG CCA AAA | LEPGEKPYKCPECGKSFSQRANL RAHQRTHTGEKPYKCPECGKSFS DCRDLARHQRTHTGEKPYKCPEC GKSFSSPADLTRHQRTHTGEKPY KCPECGKSFSQSGNLTEHQRTHT GEKPYKCPECGKSFSQSGNLTEH QRTHTGEKPYKCPECGKSFSDSG NLRVHQRTHTGEKPYKCPECGKS FSQLAHLRAHQRTHTGEKPTGKK TS | 1596 | $X_1X_2X_3X_4X_5X_6X_7X_8X_9CX_{10}X_{11}CX_{12}X_{13}X_{14}X_{15}X_{16}$QRANLRAH$X_{17}X_{18}X_{19}$H$X_{20}X_{21}X_{22}X_{23}X_{24}X_8X_9CX_{10}X_{11}CX_{12}X_{13}X_{14}X_{15}X_{16}$DCRDLARH$X_{17}X_{18}$ $X_{19}HX_{20}X_{21}X_{22}X_{23}X_{24}X_8X_9CX_{10}X_{11}CX_{12}X_{13}X_{14}X_{15}X_{16}$SPADLTRH$X_{17}$ $X_{18}X_{19}HX_{20}X_{21}X_{22}X_{23}X_{24}X_8X_9CX_{10}X_{11}CX_{12}X_{13}X_{14}X_{15}X_{16}$QSGNLT EH$X_{17}X_{18}X_{19}HX_{20}X_{21}X_{22}X_{23}X_{24}X_8X_9CX_{10}X_{11}CX_{12}X_{13}X_{14}X_{15}X_{16}$DSGN LRVH$X_{17}X_{18}X_{19}HX_{20}X_{21}X_{22}X_{23}X_{24}X_8X_9CX_{10}X_{11}CX_{12}X_{13}X_{14}X_{15}X_{16}$QL AHLRAH$X_{17}X_{18}X_{19}HX_{20}X_{21}X_{22}X_{23}X_{24}X_{25}X_{26}X_{27}X_{28}X_{29}X_{30}$ | 2145 |
| cctgcagcc ccgcccagc cta | 138 | CCT GCA GCC CCG CCC AGC CTA | LEPGEKPYKCPECGKSFSQNSTL TEHQRTHTGEKPYKCPECGKSFS ERSHLREHQRTHTGEKPYKCPEC GKSFSSKKHLAEHQRTHTGEKPY KCPECGKSFSRNDTLTEHQRTHT GEKPYKCPECGKSFSDCRDLARH QRTHTGEKPYKCPECGKSFSQSG DLRRHQRTHTGEKPYKCPECGKS FSTKNSLTEHQRTHTGEKPTGKK TS | 139 | $X_1X_2X_3X_4X_5X_6X_7X_8X_9CX_{10}X_{11}CX_{12}X_{13}X_{14}X_{15}X_{16}$QNSTLTEH$X_{17}X_{18}X_{19}$H$X_{20}X_{21}X_{22}X_{23}X_{24}X_8X_9CX_{10}X_{11}CX_{12}X_{13}X_{14}X_{15}X_{16}$ERSHLREH$X_{17}X_{18}$ $X_{19}HX_{20}X_{21}X_{22}X_{23}X_{24}X_8X_9CX_{10}X_{11}CX_{12}X_{13}X_{14}X_{15}X_{16}$SKKHLAEH$X_{17}$ $X_{18}X_{19}HX_{20}X_{21}X_{22}X_{23}X_{24}X_8X_9CX_{10}X_{11}CX_{12}X_{13}X_{14}X_{15}X_{16}$RNDTLTEH $X_{17}X_{18}X_{19}HX_{20}X_{21}X_{22}X_{23}X_{24}X_8X_9CX_{10}X_{11}CX_{12}X_{13}X_{14}X_{15}X_{16}$DCRDLA RH$X_{17}X_{18}X_{19}HX_{20}X_{21}X_{22}X_{23}X_{24}X_8X_9CX_{10}X_{11}CX_{12}X_{13}X_{14}X_{15}X_{16}$QSGD LRRH$X_{17}X_{18}X_{19}HX_{20}X_{21}X_{22}X_{23}X_{24}X_8X_9CX_{10}X_{11}CX_{12}X_{13}X_{14}X_{15}X_{16}$TK NSLTEH$X_{17}X_{18}X_{19}HX_{20}X_{21}X_{22}X_{23}X_{24}X_{25}X_{26}X_{27}X_{28}X_{29}X_{30}$ | 322 |

TABLE 10-continued

| Column 1 Nucleotide Sequence of Target Site in HNF4α Expression Control Region | Column 2 Target sequence with space | Column 3 Target sequence (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| accgcggg ggaccgatt aac | ACC GGC GGG GGA CCG ATT AAC | 1048 | LEPGEKPYKCPECGKSFSDSGNL RVHQRTHTGEKPYKCPECGKSFS HKNALQNHQRTHTGEKPYKCPEC GKSFSRNDTLTEHQRTHTGEKPY KCPECGKSFSQRAHLERHQRTHT GEKPYKCPECGKSFSRSDKLVRH QRTHTGEKPYKCPECGKSFSDPG HLVRHQRTHTGEKPYKCPECGKS FSDKKDLTRHQRTHTGEKPTGKK TS | 1597 | $X_1X_2X_3X_4X_5X_6X_7X_8X_9CX_{10}X_{11}CX_{12}X_{13}X_{14}X_{15}X_{16}DSGNLRVHX_{17}X_{18}X_{19}HX_{20}X_{21}X_{22}X_{23}X_{24}X_8X_9CX_{10}X_{11}CX_{12}X_{13}X_{14}X_{15}X_{16}HKNALQNHX_{17}X_{18}X_{19}HX_{20}X_{21}X_{22}X_{23}X_{24}X_8X_9CX_{10}X_{11}CX_{12}X_{13}X_{14}X_{15}X_{16}RNDTLTEHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}XEX_{14}X_{15}X_{16}DKKDLTRHX_{17}X_{18}X_{19}HX_{20}X_{21}X_{22}X_{23}X_{24}X_{25}X_{26}X_{27}X_{28}X_{29}X_{30}$ | 2146 |
| ggcggggga ccgattaac cat | GGC GGG GGA CCG ATT AAC CAT | 118 | LEPGEKPYKCPECGKSFSTSGNL TEHQRTHTGEKPYKCPECGKSFS DSGNLRVHQRTHTGEKPYKCPEC GKSFSHKNALQNHQRTHTGEKPY KCPECGKSFSRNDTLTEHQRTHT GEKPYKCPECGKSFSQRAHLERH QRTHTGEKPYKCPECGKSFSRSD KLVRHQRTHTGEKPYKCPECGKS FSDPGHLVRHQRTHTGEKPTGKK TS | 119 | $X_1X_2X_3X_4X_5X_6X_7X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}DSGNLRVHX_{17}X_{18}X_{19}HX_{20}X_{21}X_{22}X_{23}X_{24}X_8X_9CX_{10}X_{11}CX_{12}X_{13}X_{14}X_{15}X_{16}HKNALQNHX_{17}X_{18}X_{19}HX_{20}X_{21}X_{22}X_{23}X_{24}X_8X_9CX_{10}X_{11}CX_{12}X_{13}X_{14}X_{15}X_{16}RNDTLTEHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_{25}X_{26}X_{27}X_{28}X_{29}X_{30}$ | 317 |
| cccacccct cccgcag agc | CCC ACC CCT CCC CGG CAG AGC | 142 | LEPGEKPYKCPECGKSFSERSHL REHQRTHTGEKPYKCPECGKSFS RADNLTEHQRTHTGEKPYKCPEC GKSFSRSDKLTEHQRTHTGEKPY KCPECGKSFSSKKHLAEHQRTHT GEKPYKCPECGKSFSTKNSLTEH QRTHTGEKPYKCPECGKSFSDKK DLTRHQRTHTGEKPYKCPECGKS FSSKKHLAEHQRTHTGEKPTGKK TS | 143 | $X_1X_2X_3X_4X_5X_6X_7X_8X_9CX_{10}X_{11}CX_{12}X_{13}X_{14}X_{15}X_{16}ERSHLREHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}DKKDLTRHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_{25}X_{26}X_{27}X_{28}X_{29}X_{30}$ | 323 |
| acccccacc cctcccgg cag | ACC CCC ACC CCT CCC CGG CAG | 1049 | LEPGEKPYKCPECGKSFSRADNL TEHQRTHTGEKPYKCPECGKSFS RSDKLTEHQRTHTGEKPYKCPEC GKSFSSKKHLAEHQRTHTGEKPY KCPECGKSFSTKNSLTEHQRTHT GEKPYKCPECGKSFSDKKDLTRH QRTHTGEKPYKCPECGKSFSSKK HLAEHQRTHTGEKPYKCPECGKS FSDKKDLTRHQRTHTGEKPTGKK TS | 1598 | $X_1X_2X_3X_4X_5X_6X_7X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}DKKDLTRHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}DKKDLTRHX_{17}X_{18}X_{19}HX_{20}X_{21}X_{22}X_{23}X_{24}X_{25}X_{26}X_{27}X_{28}X_{29}X_{30}$ | 2147 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| cacagaggc taggccaag act | 1050 | CAC AGA GGC TAG GCC AAG ACT | LEPGEKPYKCPECGKSFSTHLDL IRHQRTHTGEKPYKCPECGKSFS RKDNLKNHQRTHTGEKPYKCPEC GKSFSDCRDLARHQRTHTGEKPY KCPECGKSFSREDNLHTHQRTHT GEKPYKCPECGKSFSDPGHLVRH QRTHTGEKPYKCPECGKSFSQLA HLRAHQRTHTGEKPYKCPECGKS FSSKKALTEHQRTHTGEKPTGKK TS | 1599 | $X_1X_2X_3X_4X_5X_6X_7X_8X_9CX_{10}X_{11}CX_{12}X_{13}X_{14}X_{15}X_{16}THLDLIRHX_{17}X_{18}X_{19}HX_{20}X_{21}X_{22}X_{23}X_{24}X_8X_9CX_{10}X_{11}CX_{12}X_{13}X_{14}X_{15}X_{16}RKDNLKNHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}REDNLHTHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}QLAHLRAHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_{25}X_{26}X_{27}X_{28}X_{29}X_{30}$ | 2148 |
| agaggctag gccaagact ccc | 146 | AGA GGC TAG GCC AAG ACT CCC | LEPGEKPYKCPECGKSFSSKKHL AEHQRTHTGEKPYKCPECGKSFS THLDLIRHQRTHTGEKPYKCPEC GKSFSRKDNLKNHQRTHTGEKPY KCPECGKSFSDCRDLARHQRTHT GEKPYKCPECGKSFSREDNLHTH QRTHTGEKPYKCPECGKSFSDPG HLVRHQRTHTGEKPYKCPECGKS FSQLAHLRAHQRTHTGEKPTGKK TS | 147 | $X_1X_2X_3X_4X_5X_6X_7X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}THLDLIRHX_{17}X_{18}X_{19}HX_{20}X_{21}X_{22}X_{23}X_{24}X_8X_9CX_{10}X_{11}CX_{12}X_{13}X_{14}X_{15}X_{16}RKDNLKNHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}REDNLHTHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}QLAHLRAHX_{17}X_{18}X_{19}HX_{20}X_{21}X_{22}X_{23}X_{24}X_{25}X_{26}X_{27}X_{28}X_{29}X_{30}$ | 324 |
| cttcacaga ggctaggcc aag | 1051 | CTT CAC AGA GGC TAG GCC APG | LEPGEKPYKCPECGKSFSRKDNL KNHQRTHTGEKPYKCPECGKSFS DCRDLARHQRTHTGEKPYKCPEC GKSFSREDNLHTHQRTHTGEKPY KCPECGKSFSDPGHLVRHQRTHT GEKPYKCPECGKSFSQLAHLRAH QRTHTGEKPYKCPECGKSFSSKK ALTEHQRTHTGEKPYKCPECGKS FSTTGALTEHQRTHTGEKPTGKK TS | 1600 | $X_1X_2X_3X_4X_5X_6X_7X_8X_9CX_{10}X_{11}CX_{12}X_{13}X_{14}X_{15}X_{16}RKDNLKNHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}REDNLHTHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}QLAHLRAHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}TTGALTEHX_{17}X_{18}X_{19}HX_{20}X_{21}X_{22}X_{23}X_{24}X_{25}X_{26}X_{27}X_{28}X_{29}X_{30}$ | 2149 |
| taggccaag actcccagc aga | 1052 | TAG GCC AAG ACT CCC AGC AGA | LEPGEKPYKCPECGKSFSQLAHL RAHQRTHTGEKPYKCPECGKSFS ERSHLREHQRTHTGEKPYKCPEC GKSFSSKKHLAEHQRTHTGEKPY KCPECGKSFSTHLDLIRHQRTHT GEKPYKCPECGKSFSRKDNLKNH QRTHTGEKPYKCPECGKSFSDCR DLARHQRTHTGEKPYKCPECGKS FSREDNLHTHQRTHTGEKPTGKK TS | 1601 | $X_1X_2X_3X_4X_5X_6X_7X_8X_9CX_{10}X_{11}CX_{12}X_{13}X_{14}X_{15}X_{16}QLAHLRAHX_{17}X_{18}X_{19}HX_{20}X_{21}X_{22}X_{23}X_{24}X_8X_9CX_{10}X_{11}CX_{12}X_{13}X_{14}X_{15}X_{16}ERSHLREHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}THLDLIRHX_{17}X_{18}X_{19}HX_{20}X_{21}X_{22}X_{23}X_{24}X_8X_9CX_{10}X_{11}CX_{12}X_{13}X_{14}X_{15}X_{16}RKDNLKNHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}REDNLHTHX_{17}X_{18}X_{19}HX_{20}X_{21}X_{22}X_{23}X_{24}X_{25}X_{26}X_{27}X_{28}X_{29}X_{30}$ | 2150 |

TABLE 10-continued

| Column 1 Nucleotide Sequence of Target Site in HNF4α Expression Control Region | Column 2 Target sequence with space | Column 3 Target sequence | Column 4 Amino acid Sequence of Zinc Finger DNA Binding Domain Polypeptides Targeting the Target Site in Column 1 | Column 5 SEQ ID NO. (corresponds to sequences in Columns 1 and 3) | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| ggctaggcc aagactccc agc | GGC TAG GCC AAG ACT CCC AGC | | LEPGEKPYKCPECGKSFSERSHL REHQRTHTGEKPYKCPECGKSFS SKKHLAEHQRTHTGEKPYKCPEC GKSFSTHLDLIRHQRTHTGEKPY KCPECGKSFSRKDNLKNHQRTHT GEKPYKCPECGKSFSDCRDLARH QRTHTGEKPYKCPECGKSFSRED NLHTHQRTHTGEKPYKCPECGKS FSDPGHLVRHQRTHTGEKPTGKK TS | 1053 | $X_1X_2X_3X_4X_5X_6X_7X_8X_9CX_{10}X_{11}CX_{12}X_{13}X_{14}X_{15}X_{16}$ERSHLREHX$_{17}X_{18}X_{19}$HX$_{20}X_{21}X_{22}X_{23}X_{24}X_8X_9CX_{10}X_{11}CX_{12}X_{13}X_{14}X_{15}X_{16}$SKKHLAEHX$_{17}X_{18}$X$_{19}$HX$_{20}X_{21}X_{22}X_{23}X_{24}X_8X_9CX_{10}X_{11}CX_{12}X_{13}X_{14}X_{15}X_{16}$THLDLIRHX$_{17}$X$_{18}X_{19}$HX$_{20}X_{21}X_{22}X_{23}X_{24}X_8X_9CX_{10}X_{11}CX_{12}X_{13}X_{14}X_{15}X_{16}$RKDNLKNH X$_{17}X_{18}X_{19}$HX$_{20}X_{21}X_{22}X_{23}X_{24}X_8X_9CX_{10}X_{11}CX_{12}X_{13}X_{14}X_{15}X_{16}$DCRDLA RHX$_{17}X_{18}X_{19}$HX$_{20}X_{21}X_{22}X_{23}X_{24}X_8X_9CX_{10}X_{11}CX_{12}X_{13}X_{14}X_{15}X_{16}$REDN LHTHX$_{17}X_{18}X_{19}$HX$_{20}X_{21}X_{22}X_{23}X_{24}X_8X_9CX_{10}X_{11}CX_{12}X_{13}X_{14}X_{15}X_{16}$DP GHLVRHX$_{17}X_{18}X_{19}$HX$_{20}X_{21}X_{22}X_{23}X_{24}X_{25}X_{26}X_{27}X_{28}X_{29}X_{30}$ | 2151 |
| cccctcac agagctag gcc | CCC CAC AGA GGC CTA GCC | | LEPGEKPYKCPECGKSFSDCRDL ARHQRTHTGEKPYKCPECGKSFS REDNLHTHQRTHTGEKPYKCPEC GKSFSDPGHLVRHQRTHTGEKPY KCPECGKSFSQLAHLRAHQRTHT GEKPYKCPECGKSFSSKKALTEH QRTHTGEKPYKCPECGKSFSTTG ALTEHQRTHTGEKPYKCPECGKS FSSKKHLAEHQRTHTGEKPTGKK TS | 1054 | $X_1X_2X_3X_4X_5X_6X_7X_8X_9CX_{10}X_{11}CX_{12}X_{13}X_{14}X_{15}X_{16}$DCRDLARHX$_{17}X_{18}X_{19}$HX$_{20}X_{21}X_{22}X_{23}X_{24}X_8X_9CX_{10}X_{11}CX_{12}X_{13}X_{14}X_{15}X_{16}$REDNLHTHX$_{17}X_{18}$X$_{19}$HX$_{20}X_{21}X_{22}X_{23}X_{24}X_8X_9CX_{10}X_{11}CX_{12}X_{13}X_{14}X_{15}X_{16}$DPGHLVRHX$_{17}$X$_{18}X_{19}$HX$_{20}X_{21}X_{22}X_{23}X_{24}X_8X_9CX_{10}X_{11}CX_{12}X_{13}X_{14}X_{15}X_{16}$QLAHLRAH X$_{17}X_{18}X_{19}$HX$_{20}X_{21}X_{22}X_{23}X_{24}X_8X_9CX_{10}X_{11}CX_{12}X_{13}X_{14}X_{15}X_{16}$SKKALT EHX$_{17}X_{18}X_{19}$HX$_{20}X_{21}X_{22}X_{23}X_{24}X_8X_9CX_{10}X_{11}CX_{12}X_{13}X_{14}X_{15}X_{16}$TTGA LTEHX$_{17}X_{18}X_{19}$HX$_{20}X_{21}X_{22}X_{23}X_{24}X_8X_9CX_{10}X_{11}CX_{12}X_{13}X_{14}X_{15}X_{16}$SK KHLAEHX$_{17}X_{18}X_{19}$HX$_{20}X_{21}X_{22}X_{23}X_{24}X_{25}X_{26}X_{27}X_{28}X_{29}X_{30}$ | 2152 |
| ccaccccctt cacagaggc tag | CCA CCC CTT CAC AGA GGC TAG | | LEPGEKPYKCPECGKSFSREDNL HTHQRTHTGEKPYKCPECGKSFS DPGHLVRHQRTHTGEKPYKCPEC GKSFSQLAHLRAHQRTHTGEKPY KCPECGKSFSSKKALTEHQRTHT GEKPYKCPECGKSFSTTGALTEH QRTHTGEKPYKCPECGKSFSSKK HLAEHQRTHTGEKPYKCPECGKS FSTSHSLTEHQRTHTGEKPTGKK TS | 1055 | $X_1X_2X_3X_4X_5X_6X_7X_8X_9CX_{10}X_{11}CX_{12}X_{13}X_{14}X_{15}X_{16}$REDNLHTHX$_{17}X_{18}$X$_{19}$HX$_{20}X_{21}X_{22}X_{23}X_{24}X_8X_9CX_{10}X_{11}CX_{12}X_{13}X_{14}X_{15}X_{16}$DPGHLVRHX$_{17}X_{18}$HX$_{20}X_{21}X_{22}X_{23}X_{24}X_8X_9CX_{10}X_{11}CX_{12}X_{13}X_{14}X_{15}X_{16}$QLAHLRAHX$_{17}$X$_{18}X_{19}$HX$_{20}X_{21}X_{22}X_{23}X_{24}X_8X_9CX_{10}X_{11}CX_{12}X_{13}X_{14}X_{15}X_{16}$SKKALTEH X$_{17}X_{18}X_{19}$HX$_{20}X_{21}X_{22}X_{23}X_{24}X_8X_9CX_{10}X_{11}CX_{12}X_{13}X_{14}X_{15}X_{16}$TTGALT EHX$_{17}X_{18}X_{19}$HX$_{20}X_{21}X_{22}X_{23}X_{24}X_8X_9CX_{10}X_{11}CX_{12}X_{13}X_{14}X_{15}X_{16}$SKKH LAEHX$_{17}X_{18}X_{19}$HX$_{20}X_{21}X_{22}X_{23}X_{24}X_8X_9CX_{10}X_{11}CX_{12}X_{13}X_{14}X_{15}X_{16}$TS HSLTEHX$_{17}X_{18}X_{19}$HX$_{20}X_{21}X_{22}X_{23}X_{24}X_{25}X_{26}X_{27}X_{28}X_{29}X_{30}$ | 2153 |
| cctccaccc cttcacaga ggc | CCT CCA CCC CTT CAC AGA GGC | | LEPGEKPYKCPECGKSFSDPGHL VRHQRTHTGEKPYKCPECGKSFS QLAHLRAHQRTHTGEKPYKCPEC GKSFSSKKALTEHQRTHTGEKPY KCPECGKSFSTTGALTEHQRTHT GEKPYKCPECGKSFSSKKHLAEH QRTHTGEKPYKCPECGKSFSTSH SLTEHQRTHTGEKPYKCPECGKS FSTKNSLTEHQRTHTGEKPTGKK TS | 1056 | $X_1X_2X_3X_4X_5X_6X_7X_8X_9CX_{10}X_{11}CX_{12}X_{13}X_{14}X_{15}X_{16}$DPGHLVRHX$_{17}X_{18}X_{19}$HX$_{20}X_{21}X_{22}X_{23}X_{24}X_8X_9CX_{10}X_{11}CX_{12}X_{13}X_{14}X_{15}X_{16}$QLAHLRAHX$_{17}X_{18}$X$_{19}$HX$_{20}X_{21}X_{22}X_{23}X_{24}X_8X_9CX_{10}X_{11}CX_{12}X_{13}X_{14}X_{15}X_{16}$SKKALTEHX$_{17}$X$_{18}X_{19}$HX$_{20}X_{21}X_{22}X_{23}X_{24}X_8X_9CX_{10}X_{11}CX_{12}X_{13}X_{14}X_{15}X_{16}$TTGALTEH X$_{17}X_{18}X_{19}$HX$_{20}X_{21}X_{22}X_{23}X_{24}X_8X_9CX_{10}X_{11}CX_{12}X_{13}X_{14}X_{15}X_{16}$SKKHLA EHX$_{17}X_{18}X_{19}$HX$_{20}X_{21}X_{22}X_{23}X_{24}X_8X_9CX_{10}X_{11}CX_{12}X_{13}X_{14}X_{15}X_{16}$TSHS LTEHX$_{17}X_{18}X_{19}$HX$_{20}X_{21}X_{22}X_{23}X_{24}X_8X_9CX_{10}X_{11}CX_{12}X_{13}X_{14}X_{15}X_{16}$TK NSLTEHX$_{17}X_{18}X_{19}$HX$_{20}X_{21}X_{22}X_{23}X_{24}X_{25}X_{26}X_{27}X_{28}X_{29}X_{30}$ | 2154 |

TABLE 10-continued

| Column 1 Nucleotide Sequence of Target Site in HNF4α Expression Control Region | Column 2 Target sequence with space | Column 3 Target sequence | Column 4 SEQ ID NO. (corresponds to sequences in Columns 1 and 3) | Column 5 Amino acid Sequence of Zinc Finger DNA Binding Domain Polypeptides Targeting the Target Site in Column 1 | Column 6 SEQ ID NO: | Column 7 Amino Acid Sequence Structure of Zinc Finger DNA Binding Domain Polypeptides Targeting the Target Site in Column 1 (see Table 1B above and description thereof) | SEQ ID NO: |
|---|---|---|---|---|---|---|---|
| gcagagcct ccaccccttt cac | gca gag cct cca cccc ttt cac | GCA gag CCT CCA CCC CTT CAC | 1057 | LEPGEKPYKCPECGKSFSSKKAL TEHQRTHTGEKPYKCPECGKSFS TTGALTEHQRTHTGEKPYKCPEC GKSFSSKKHLAEHQRTHTGEKPY KCPECGKSFSTSHSLTEHQRTHT GEKPYKCPECGKSFSTKNSLTEH QRTHTGEKPYKCPECGKSFSRSD NLVRHQRTHTGEKPYKCPECGKS FSQSGDLRRHQRTHTGEKPTGKK TS | 1606 | $X_1X_2X_3X_4X_5X_6X_7X_8X_9CX_{10}X_{11}CX_{12}X_{13}X_{14}X_{15}X_{16}$SKKALTEH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$TTGALTEH$X_{17}X_{18}$ $X_{19}HX_{20}X_{21}X_{22}X_{23}X_{24}X_8X_9CX_{10}X_{11}CX_{12}X_{13}X_{14}X_{15}X_{16}$SKKHLAEH$X_{17}$ $X_{18}X_{19}HX_{20}X_{21}X_{22}X_{23}X_{24}X_8X_9CX_{10}X_{11}CX_{12}X_{13}X_{14}X_{15}X_{16}$TSHSLTEH $X_{17}X_{18}X_{19}HX_{20}X_{21}X_{22}X_{23}X_{24}X_8X_9CX_{10}X_{11}CX_{12}X_{13}X_{14}X_{15}X_{16}$TKNSLT EH$X_{17}X_{18}X_{19}HX_{20}X_{21}X_{22}X_{23}X_{24}X_8X_9CX_{10}X_{11}CX_{12}X_{13}X_{14}X_{15}X_{16}$RSDN LVRH$X_{17}X_{18}X_{19}HX_{20}X_{21}X_{22}X_{23}X_{24}X_8X_9CX_{10}X_{11}CX_{12}X_{13}X_{14}X_{15}X_{16}$QS GDLRRH$X_{17}X_{18}X_{19}HX_{20}X_{21}X_{22}X_{23}X_{24}X_{25}X_{26}X_{27}X_{28}X_{29}X_{30}$ | 2155 |
| gagctccac cccttcaca aga | gag ctc cac ccct tca caga | gag CCT CCA CTT CAC AGA | 1058 | LEPGEKPYKCPECGKSFSQLAHL RAHQRTHTGEKPYKCPECGKSFS SKKALTEHQRTHTGEKPYKCPEC GKSFSTTGALTEHQRTHTGEKPY KCPECGKSFSSKKHLAEHQRTHT GEKPYKCPECGKSFSTSHSLTEH QRTHTGEKPYKCPECGKSFSTKN SLTEHQRTHTGEKPYKCPECGKS FSRSDNLVRHQRTHTGEKPTGKK TS | 1607 | $X_1X_2X_3X_4X_5X_6X_7X_8X_9CX_{10}X_{11}CX_{12}X_{13}X_{14}X_{15}X_{16}$QLAHLRAH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$SKKALTEH$X_{17}X_{18}$ $X_{19}HX_{20}X_{21}X_{22}X_{23}X_{24}X_8X_9CX_{10}X_{11}CX_{12}X_{13}X_{14}X_{15}X_{16}$TTGALTEH$X_{17}$ $X_{18}X_{19}HX_{20}X_{21}X_{22}X_{23}X_{24}X_8X_9CX_{10}X_{11}CX_{12}X_{13}X_{14}X_{15}X_{16}$SKKHLAEH $X_{17}X_{18}X_{19}HX_{20}X_{21}X_{22}X_{23}X_{24}X_8X_9CX_{10}X_{11}CX_{12}X_{13}X_{14}X_{15}X_{16}$TSHSLT EH$X_{17}X_{18}X_{19}HX_{20}X_{21}X_{22}X_{23}X_{24}X_8X_9CX_{10}X_{11}CX_{12}X_{13}X_{14}X_{15}X_{16}$TKNS LTEH$X_{17}X_{18}X_{19}HX_{20}X_{21}X_{22}X_{23}X_{24}X_8X_9CX_{10}X_{11}CX_{12}X_{13}X_{14}X_{15}X_{16}$RS DNLVRH$X_{17}X_{18}X_{19}HX_{20}X_{21}X_{22}X_{23}X_{24}X_{25}X_{26}X_{27}X_{28}X_{29}X_{30}$ | 2156 |
| ccggcagag cctccaccc ctt | ccg gca gag cct cca ccc ctt | CCG GCA gag CCT CCA CCC CTT | 1059 | LEPGEKPYKCPECGKSFSTTGAL TEHQRTHTGEKPYKCPECGKSFS SKKHLAEHQRTHTGEKPYKCPEC GKSFSTSHSLTEHQRTHTGEKPY KCPECGKSFSTKNSLTEHQRTHT GEKPYKCPECGKSFSRSDNLVRH QRTHTGEKPYKCPECGKSFSQSG DLRRHQRTHTGEKPYKCPECGKS FSRNDTLTEHQRTHTGEKPTGKK TS | 1608 | $X_1X_2X_3X_4X_5X_6X_7X_8X_9CX_{10}X_{11}CX_{12}X_{13}X_{14}X_{15}X_{16}$TTGALTEH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$SKKHLAEH$X_{17}X_{18}$ $X_{19}HX_{20}X_{21}X_{22}X_{23}X_{24}X_8X_9CX_{10}X_{11}CX_{12}X_{13}X_{14}X_{15}X_{16}$TSHSLTEH$X_{17}$ $X_{18}X_{19}HX_{20}X_{21}X_{22}X_{23}X_{24}X_8X_9CX_{10}X_{11}CX_{12}X_{13}X_{14}X_{15}X_{16}$TKNSLTEH $X_{17}X_{18}X_{19}HX_{20}X_{21}X_{22}X_{23}X_{24}X_8X_9CX_{10}X_{11}CX_{12}X_{13}X_{14}X_{15}X_{16}$RSDNLV RH$X_{17}X_{18}X_{19}HX_{20}X_{21}X_{22}X_{23}X_{24}X_8X_9CX_{10}X_{11}CX_{12}X_{13}X_{14}X_{15}X_{16}$QSGD LRRH$X_{17}X_{18}X_{19}HX_{20}X_{21}X_{22}X_{23}X_{24}X_{25}X_{26}X_{27}X_{28}X_{29}X_{30}$RN DTLTEH$X_{17}X_{18}X_{19}HX_{20}X_{21}X_{22}X_{23}X_{24}X_{25}X_{26}X_{27}X_{28}X_{29}X_{30}$ | 2157 |
| gcagatctt cccagagga cgg | gca gat ctt ccca gagga cgg | GCA GAT CTT CCC AGA GGA CGG | 1060 | LEPGEKPYKCPECGKSFSRSDKL TEHQRTHTGEKPYKCPECGKSFS QRAHLERHQRTHTGEKPYKCPEC GKSFSQLAHLRAHQRTHTGEKPY KCPECGKSSKKHLAEHQRTHT GEKPYKCPECGKSFSTTGALTEH QRTHTGEKPYKCPECGKSFSTSG NLVRHQRTHTGEKPYKCPECGKS FSQSGDLRRHQRTHTGEKPTGKK TS | 1609 | $X_1X_2X_3X_4X_5X_6X_7X_8X_9CX_{10}X_{11}CX_{12}X_{13}X_{14}X_{15}X_{16}$RSDKLTEH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$QRAHLERH$X_{17}X_{18}$ $X_{19}HX_{20}X_{21}X_{22}X_{23}X_{24}X_8X_9CX_{10}X_{11}CX_{12}X_{13}X_{14}X_{15}X_{16}$QLAHLRAH$X_{17}$ $X_{18}X_{19}HX_{20}X_{21}X_{22}X_{23}X_{24}X_8X_9CX_{10}X_{11}CX_{12}X_{13}X_{14}X_{15}X_{16}$SKKHLAEH $X_{17}X_{18}X_{19}HX_{20}X_{21}X_{22}X_{23}X_{24}X_8X_9CX_{10}X_{11}CX_{12}X_{13}X_{14}X_{15}X_{16}$TTGALT EH$X_{17}X_{18}X_{19}HX_{20}X_{21}X_{22}X_{23}X_{24}X_8X_9CX_{10}X_{11}CX_{12}X_{13}X_{14}X_{15}X_{16}$TSGN LVRH$X_{17}X_{18}X_{19}HX_{20}X_{21}X_{22}X_{23}X_{24}X_8X_9CX_{10}X_{11}CX_{12}X_{13}X_{14}X_{15}X_{16}$QS GDLRRH$X_{17}X_{18}X_{19}HX_{20}X_{21}X_{22}X_{23}X_{24}X_{25}X_{26}X_{27}X_{28}X_{29}X_{30}$ | 2158 |

TABLE 10-continued

| Column 1 Nucleotide Sequence of Target Site in HNF4α Expression Control Region | Column 2 Target sequence with space | Column 3 SEQ ID NO. (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| ccagcagat cttcccaga gga | CCA GCA GAT CTT CCC AGA GGA | 114 | LEPGEKPYKCPECGKSFSQRAHL ERHQRTHTGEKPYKCPECGKSFS QLAHLRAHQRTHTGEKPYKCPEC GKSFSSKKHLAEHQRTHTGEKPY KCPECGKSFSTTGALTEHQRTHT GEKPYKCPECGKSFSTSGNLVRH QRTHTGEKPYKCPECGKSFSQSG DLRRHQRTHTGEKPYKCPECGKS FSTSHSLTEHQRTHTGEKPTGKK TS | 115 | $X_1X_2X_3X_4X_5X_6X_7X_8X_9CX_{10}X_{11}CX_{12}X_{13}X_{14}X_{15}X_{16}QRAHLERHX_{17}X_{18}X_{19}$ $HX_{20}X_{21}X_{22}X_{23}X_{24}X_8X_9CX_{10}X_{11}CX_{12}X_{13}X_{14}X_{15}X_{16}QLAHLRAHX_{17}X_{18}$ $X_{19}HX_{20}X_{21}X_{22}X_{23}X_{24}X_8X_9CX_{10}X_{11}CX_{12}X_{13}X_{14}X_{15}X_{16}SKKHLAEHX_{17}$ $X_{18}X_{19}HX_{20}X_{21}X_{22}X_{23}X_{24}X_8X_9CX_{10}X_{11}CX_{12}X_{13}X_{14}X_{15}X_{16}TTGALTEH$ $X_{17}X_{18}X_{19}HX_{20}X_{21}X_{22}X_{23}X_{24}X_8X_9CX_{10}X_{11}CX_{12}X_{13}X_{14}X_{15}X_{16}TSGNLV$ $RHX_{17}X_{18}X_{19}HX_{20}X_{21}X_{22}X_{23}X_{24}X_8X_9CX_{10}X_{11}CX_{12}X_{13}X_{14}X_{15}X_{16}QSGD$ $LRRHX_{17}X_{18}X_{19}HX_{20}X_{21}X_{22}X_{23}X_{24}X_8X_9CX_{10}X_{11}CX_{12}X_{13}X_{14}X_{15}X_{16}TS$ $HSLTEHX_{17}X_{18}X_{19}HX_{20}X_{21}X_{22}X_{23}X_{24}X_{25}X_{26}X_{27}X_{28}X_{29}X_{30}$ | 316 |
| ggcagagag ggcactggg agg | GGC AGA GAG GGC ACT ggg AGG | 1061 | LEPGEKPYKCPECGKSFSRSDHL TNHQRTHTGEKPYKCPECGKSFS RSDKLVRHQRTHTGEKPYKCPEC GKSFSTHLDIIRHQRTHTGEKPY KCPECGKSFSDPGHLVRHQRTHT GEKPYKCPECGKSFSRSDNLVRH QRTHTGEKPYKCPECGKSFSQLA HLRAHQRTHTGEKPYKCPECGKS FSDPGHLVRHQRTHTGEKPTGKK TS | 1610 | $X_1X_2X_3X_4X_5X_6X_7X_8X_9CX_{10}X_{11}CX_{12}X_{13}X_{14}X_{15}X_{16}RSDHLTNHX_{17}X_{18}X_{19}$ $HX_{20}X_{21}X_{22}X_{23}X_{24}X_8X_9CX_{10}X_{11}CX_{12}X_{13}X_{14}X_{15}X_{16}RSDKLVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}THLDLIRHX_{17}$ $X_{18}X_{19}HX_{20}X_{21}X_{22}X_{23}X_{24}X_8X_9CX_{10}X_{11}CX_{12}X_{13}X_{14}X_{15}X_{16}DPGHLVRH$ $X_{17}X_{18}X_{19}HX_{20}X_{21}X_{22}X_{23}X_{24}X_8X_9CX_{10}X_{11}CX_{12}X_{13}X_{14}X_{15}X_{16}RSDNLV$ $RHX_{17}X_{18}X_{19}HX_{20}X_{21}X_{22}X_{23}X_{24}X_8X_9CX_{10}X_{11}CX_{12}X_{13}X_{14}X_{15}X_{16}QLAH$ $LRAHX_{17}X_{18}X_{19}HX_{20}X_{21}X_{22}X_{23}X_{24}X_8X_9CX_{10}X_{11}CX_{12}X_{13}X_{14}X_{15}X_{16}DP$ $GHLVRHX_{17}X_{18}X_{19}HX_{20}X_{21}X_{22}X_{23}X_{24}X_{25}X_{26}X_{27}X_{28}X_{29}X_{30}$ | 2159 |
| gaaggcaga gagggcact ggg | GAA GGC AGA GAG GGC ACT GGG | 1062 | LEPGEKPYKCPECGKSFSRSDKL VRHQRTHTGEKPYKCPECGKSFS THLDLIRHQRTHTGEKPYKCPEC GKSFSDPGHLVRHQRTHTGEKPY KCPECGKSFSRSDNLVRHQRTHT GEKPYKCPECGKSFSQLAHLRAH QRTHTGEKPYKCPECGKSFSDPG HLVRHQRTHTGEKPYKCPECGKS FSQSSNLVRHQRTHTGEKPTGKK TS | 1611 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}$ $HX_{20}X_{21}X_{22}X_{23}X_{24}X_8X_9CX_{10}X_{11}CX_{12}X_{13}X_{14}X_{15}X_{16}THLDLIRHX_{17}X_{18}$ $X_{19}HX_{20}X_{21}X_{22}X_{23}X_{24}X_8X_9CX_{10}X_{11}CX_{12}X_{13}X_{14}X_{15}X_{16}DPGHLVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}RSDNLVRH$ $X_{17}X_{18}X_{19}HX_{20}X_{21}X_{22}X_{23}X_{24}X_8X_9CX_{10}X_{11}CX_{12}X_{13}X_{14}X_{15}X_{16}QLAHLR$ $AHX_{17}X_{18}X_{19}HX_{20}X_{21}X_{22}X_{23}X_{24}X_8X_9CX_{10}X_{11}CX_{12}X_{13}X_{14}X_{15}X_{16}DPGH$ $LVRHX_{17}X_{18}X_{19}HX_{20}X_{21}X_{22}X_{23}X_{24}X_8X_9CX_{10}X_{11}CX_{12}X_{13}X_{14}X_{15}X_{16}QS$ $SNLVRHX_{17}X_{18}X_{19}HX_{20}X_{21}X_{22}X_{23}X_{24}X_{25}X_{26}X_{27}X_{28}X_{29}X_{30}$ | 2160 |
| gagggcact gggaggcag cag | GAG GGC ACT ggg AGG CAG | 1063 | LEPGEKPYKCPECGKSFSRADNL TEHQRTHTGEKPYKCPECGKSFS RSDHLTNHQRTHTGEKPYKCPEC GKSFSRSDKLVRHQRTHTGEKPY KCPECGKSFSRSDKLVRHQRTHT GEKPYKCPECGKSFSTHLDLIRH QRTHTGEKPYKCPECGKSFSDPG HLVRHQRTHTGEKPYKCPECGKS FSRSDNLVRHQRTHTGEKPTGKK TS | 1612 | $X_1X_2X_3X_4X_5X_6X_7X_8X_9CX_{10}X_{11}CX_{12}X_{13}X_{14}X_{15}X_{16}RADNLTEHX_{17}X_{18}X_{19}$ $HX_{20}X_{21}X_{22}X_{23}X_{24}X_8X_9CX_{10}X_{11}CX_{12}X_{13}X_{14}X_{15}X_{16}RSDHLTNHX_{17}X_{18}$ $X_{19}HX_{20}X_{21}X_{22}X_{23}X_{24}X_8X_9CX_{10}X_{11}CX_{12}X_{13}X_{14}X_{15}X_{16}RSDKLVRH$ $X_{18}X_{19}HX_{20}X_{21}X_{22}X_{23}X_{24}X_8X_9CX_{10}X_{11}CX_{12}X_{13}X_{14}X_{15}X_{16}RSDKLVRH$ $X_{17}X_{18}X_{19}HX_{20}X_{21}X_{22}X_{23}X_{24}X_8X_9CX_{10}X_{11}CX_{12}X_{13}X_{14}X_{15}X_{16}THLDLI$ $RHX_{17}X_{18}X_{19}HX_{20}X_{21}X_{22}X_{23}X_{24}X_8X_9CX_{10}X_{11}CX_{12}X_{13}X_{14}X_{15}X_{16}DPGH$ $LVRHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DNLVRHX_{17}X_{18}X_{19}HX_{20}X_{21}X_{22}X_{23}X_{24}X_{25}X_{26}X_{27}X_{28}X_{29}X_{30}$ | 2161 |

TABLE 10-continued

| Column 1 Nucleotide Sequence of Target Site in HNF4α Expression Control Region | Column 3 Target sequence with space | Column 2 SEQ ID NO. (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| agagagggc actgggagg agg | AGA GAG GGC ACT ggg AGG | 1064 | LEPGEKPYKCPECGKSFSRSDHL TNHQRTHTGEKPYKCPECGKSFS RSDHLTNHQRTHTGEKPYKCPEC GKSFSRSDKLVRHQRTHTGEKPY KCPECGKSFSTHLDLIRHQRTHT GEKPYKCPECGKSFSDPGHLVRH QRTHTGEKPYKCPECGKSFSRSD NLVRHQRTHTGEKPYKCPECGKS FSQLAHLRAHQRTHTGEKPTGKK TS | 1613 | $X_1X_2X_3X_4X_5X_6X_7X_8X_9CX_{10}X_{11}CX_{12}X_{13}X_{14}X_{15}X_{16}RSDHLTNHX_{17}X_{18}X_{19}$ $HX_{20}X_{21}X_{22}X_{23}X_{24}X_8X_9CX_{10}X_{11}CX_{12}X_{13}X_{14}X_{15}X_{16}RSDHLTNHX_{17}X_{18}$ $X_{19}HX_{20}X_{21}X_{22}X_{23}X_{24}X_8X_9CX_{10}X_{11}CX_{12}X_{13}X_{14}X_{15}X_{16}RSDKLVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}THLDLIRH$ $X_{17}X_{18}X_{19}HX_{20}X_{21}X_{22}X_{23}X_{24}X_8X_9CX_{10}X_{11}CX_{12}X_{13}X_{14}X_{15}X_{16}DPGHLV$ $RHX_{17}X_{18}X_{19}HX_{20}X_{21}X_{22}X_{23}X_{24}X_8X_9CX_{10}X_{11}CX_{12}X_{13}X_{14}X_{15}X_{16}RSDN$ $LVRHX_{17}X_{18}X_{19}HX_{20}X_{21}X_{22}X_{23}X_{24}X_8X_9CX_{10}X_{11}CX_{12}X_{13}X_{14}X_{15}X_{16}QL$ $AHLRAHX_{17}X_{18}X_{19}HX_{20}X_{21}X_{22}X_{23}X_{24}X_{25}X_{26}X_{27}X_{28}X_{29}X_{30}$ | 2162 |
| gggaggagg cagtgggag ggc | ggg AGG AGG CAG TGG GAG GGC | 1065 | LEPGEKPYKCPECGKSFSDPGHL VRHQRTHTGEKPYKCPECGKSFS RSDNLVRHQRTHTGEKPYKCPEC GKSFSRSDHLTTHQRTHTGEKPY KCPECGKSFSRADNLTEHQRTHT GEKPYKCPECGKSFSRSDHLTNH QRTHTGEKPYKCPECGKSFSRSD HLTNHQRTHTGEKPYKCPECGKS FSRSDKLVRHQRTHTGEKPTGKK TS | 1614 | $X_1X_2X_3X_4X_5X_6X_7X_8X_9CX_{10}X_{11}CX_{12}X_{13}X_{14}X_{15}X_{16}DPGHLVRHX_{17}X_{18}X_{19}$ $HX_{20}X_{21}X_{22}X_{23}X_{24}X_8X_9CX_{10}X_{11}CX_{12}X_{13}X_{14}X_{15}X_{16}RSDNLVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}RSDHLTEH$ $X_{18}X_{19}HX_{20}X_{21}X_{22}X_{23}X_{24}X_8X_9CX_{10}X_{11}CX_{12}X_{13}X_{14}X_{15}X_{16}RADNLTEH$ $X_{17}X_{18}X_{19}HX_{20}X_{21}X_{22}X_{23}X_{24}X_8X_9CX_{10}X_{11}CX_{12}X_{13}X_{14}X_{15}X_{16}RSDHLT$ $NHX_{17}X_{18}X_{19}HX_{20}X_{21}X_{22}X_{23}X_{24}X_8X_9CX_{10}X_{11}CX_{12}X_{13}X_{14}X_{15}X_{16}RSDH$ $LTNHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DKLVRHX_{17}X_{18}X_{19}HX_{20}X_{21}X_{22}X_{23}X_{24}X_{25}X_{26}X_{27}X_{28}X_{29}X_{30}$ | 2163 |
| ggcactggg aggagcag tgg | GGC ACT ggg AGG AGG CAG TGG | 1066 | LEPGEKPYKCPECGKSFSRSDHL TTHQRTHTGEKPYKCPECGKSFS RADNLTEHQRTHTGEKPYKCPEC GKSFSRSDHLTNHQRTHTGEKPY KCPECGKSFSRSDHLTNHQRTHT GEKPYKCPECGKSFSRSDKLVRH QRTHTGEKPYKCPECGKSFSTHL DLIRHQRTHTGEKPYKCPECGKS FSDPGHLVRHQRTHTGEKPTGKK TS | 1615 | $X_1X_2X_3X_4X_5X_6X_7X_8X_9CX_{10}X_{11}CX_{12}X_{13}X_{14}X_{15}X_{16}RSDHLTTHX_{17}X_{18}X_{19}$ $HX_{20}X_{21}X_{22}X_{23}X_{24}X_8X_9CX_{10}X_{11}CX_{12}X_{13}X_{14}X_{15}X_{16}RADNLTEHX_{17}X_{18}$ $X_{19}HX_{20}X_{21}X_{22}X_{23}X_{24}X_8X_9CX_{10}X_{11}CX_{12}X_{13}X_{14}X_{15}X_{16}RSDHLTNH$ $X_{18}X_{19}HX_{20}X_{21}X_{22}X_{23}X_{24}X_8X_9CX_{10}X_{11}CX_{12}X_{13}X_{14}X_{15}X_{16}RSDHLTNH$ $X_{17}X_{18}X_{19}HX_{20}X_{21}X_{22}X_{23}X_{24}X_8X_9CX_{10}X_{11}CX_{12}X_{13}X_{14}X_{15}X_{16}RSDKLV$ $RHX_{17}X_{18}X_{19}HX_{20}X_{21}X_{22}X_{23}X_{24}X_8X_9CX_{10}X_{11}CX_{12}X_{13}X_{14}X_{15}X_{16}THLD$ $LIRHX_{17}X_{18}X_{19}HX_{20}X_{21}X_{22}X_{23}X_{24}X_8X_9CX_{10}X_{11}CX_{12}X_{13}X_{14}X_{15}X_{16}DP$ $GHLVRHX_{17}X_{18}X_{19}HX_{20}X_{21}X_{22}X_{23}X_{24}X_{25}X_{26}X_{27}X_{28}X_{29}X_{30}$ | 2164 |
| gagggcgga gggcgggggg cct | GAG GGC GGA ggg CGG ggg CCT | 1067 | LEPGEKPYKCPECGKSFSTKNSL TEHQRTHTGEKPYKCPECGKSFS RSDKLVRHQRTHTGEKPYKCPEC GKSFSRSDKLTEHQRTHTGEKPY KCPECGKSFSRSDKLVRHQRTHT GEKPYKCPECGKSFSQRAHLERH QRTHTGEKPYKCPECGKSFSDPG HLVRHQRTHTGEKPYKCPECGKS FSRSDNLVRHQRTHTGEKPTGKK TS | 1616 | $X_1X_2X_3X_4X_5X_6X_7X_8X_9CX_{10}X_{11}CX_{12}X_{13}X_{14}X_{15}X_{16}TKNSLTEHX_{17}X_{18}X_{19}$ $HX_{20}X_{21}X_{22}X_{23}X_{24}X_8X_9CX_{10}X_{11}CX_{12}X_{13}X_{14}X_{15}X_{16}RSDKLVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}RSDKLTEHX_{17}$ $X_{18}X_{19}HX_{20}X_{21}X_{22}X_{23}X_{24}X_8X_9CX_{10}X_{11}CX_{12}X_{13}X_{14}X_{15}X_{16}RSDKLVRH$ $X_{17}X_{18}X_{19}HX_{20}X_{21}X_{22}X_{23}X_{24}X_8X_9CX_{10}X_{11}CX_{12}X_{13}X_{14}X_{15}X_{16}QRAHLE$ $RHX_{17}X_{18}X_{19}HX_{20}X_{21}X_{22}X_{23}X_{24}X_8X_9CX_{10}X_{11}CX_{12}X_{13}X_{14}X_{15}X_{16}DPGH$ $LVRHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DNLVRHX_{17}X_{18}X_{19}HX_{20}X_{21}X_{22}X_{23}X_{24}X_{25}X_{26}X_{27}X_{28}X_{29}X_{30}$ | 2165 |

TABLE 10-continued

| Column 1 Nucleotide Sequence of Target Site in HNF4α Expression Control Region | Column 3 Target sequence with space | Column 2 SEQ ID NO. (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| actgggagg aggcagtgg gag | ACT ggg AGG AGG CAG TGG GAG | 1068 | LEPGEKPYKCPECGKSFSRSDNL VRHQRTHTGEKPYKCPECGKSFS RSDHLTTHQRTHTGEKPYKCPEC GKSFSRADNLTEHQRTHTGEKPY KCPECGKSFSRSDHLTNHQRTHT GEKPYKCPECGKSFSRSDHLTNH QRTHTGEKPYKCPECGKSFSRSD KLVRHQRTHTGEKPYKCPECGKS FSTHLDLIRHQRTHTGEKPTGKK TS | 1617 | $X_1X_2X_3X_4X_5X_6X_7X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}THLDLIRHX_{17}X_{18}X_{19}HX_{20}X_{21}X_{22}X_{23}X_{24}X_{25}X_{26}X_{27}X_{28}X_{29}X_{30}$ | 2166 |
| tgaaaggaa ggcagagag ggc | TGA AAG GAA GGC AGA GAG GGC | 1069 | LEPGEKPYKCPECGKSFSDPGHL VRHQRTHTGEKPYKCPECGKSFS RSDNLVRHQRTHTGEKPYKCPEC GKSFSQLAHLRAHQRTHTGEKPY KCPECGKSFSDPGHLVRHQRTHT GEKPYKCPECGKSFSQSSNLVRH QRTHTGEKPYKCPECGKSFSRKD NLKNHQRTHTGEKPYKCPECGKS FSQAGHLASHQRTHTGEKPTGKK TS | 1618 | $X_1X_2X_3X_4X_5X_6X_7X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}QLAHLRAHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSSNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RKDNLKNHX_{17}X_{18}X_{19}HX_{20}X_{21}X_{22}X_{23}X_{24}X_8X_9CX_{10}X_{11}CX_{12}X_{13}X_{14}X_{15}X_{16}QAGHLASHX_{17}X_{18}X_{19}HX_{20}X_{21}X_{22}X_{23}X_{24}X_{25}X_{26}X_{27}X_{28}X_{29}X_{30}$ | 2167 |
| aaggaaggc agagaggge act | AAG GAA GGC AGA GAG GGC ACT | 1070 | LEPGEKPYKCPECGKSFSTHLDL IRHQRTHTGEKPYKCPECGKSFS DPGHLVRHQRTHTGEKPYKCPEC GKSFSRSDNLVRHQRTHTGEKPY KCPECGKSFSQLAHLRAHQRTHT GEKPYKCPECGKSFSDPGHLVRH QRTHTGEKPYKCPECGKSFSQSS NLVRHQRTHTGEKPYKCPECGKS FSRKDNLKNHQRTHTGEKPTGKK TS | 1619 | $X_1X_2X_3X_4X_5X_6X_7X_8X_9CX_{10}X_{11}CX_{12}X_{13}X_{14}X_{15}X_{16}THLDLIRHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}QLAHLRAHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSSNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RKDNLKNHX_{17}X_{18}X_{19}HX_{20}X_{21}X_{22}X_{23}X_{24}X_{25}X_{26}X_{27}X_{28}X_{29}X_{30}$ | 2168 |
| tgggaggc ggagggcgg ggg | TGG GAG GGC GGA ggg CGG GGG | 1071 | LEPGEKPYKCPECGKSFSRSDKL VRHQRTHTGEKPYKCPECGKSFS RSDKLTEHQRTHTGEKPYKCPEC GKSFSRSDKLVRHQRTHTGEKPY KCPECGKSFSQRAHLERHQRTHT GEKPYKCPECGKSFSDPGHLVRH QRTHTGEKPYKCPECGKSFSRSD NLVRHQRTHTGEKPYKCPECGKS FSRSDHLTTHQRTHTGEKPTGKK TS | 1620 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_{25}X_{26}X_{27}X_{28}X_{29}X_{30}$ | 2169 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| cagtgggag gggaggg cgg | 1072 | CAG TGG GAG GGG AGG GCG GGA GGG CGG | LEPGEKPYKCPECGKSFSRSDKL TEHQRTHTGEKPYKCPECGKSFS RSDKLVRHQRTHTGEKPYKCPEC GKSFSQRAHLERHQRTHTGEKPY KCPECGKSFSDPGHLVRHQRTHT GEKPYKCPECGKSFSRSDNLVRH QRTHTGEKPYKCPECGKSFSRSD HLTTHQRTHTGEKPYKCPECGKS FSRADNLTEHQRTHTGEKPTGKK TS | 1621 | $X_1X_2X_3X_4X_5X_6X_7X_8X_9CX_{10}X_{11}CX_{12}X_{13}X_{14}X_{15}X_{16}RSDKLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_{25}X_{26}X_{27}X_{28}X_{29}X_{30}$ | 2170 |
| aggcagtgg gaggcgga ggg | 1073 | AGG CAG TGG GAG GGC GGA GGG | LEPGEKPYKCPECGKSFSRSDKL VRHQRTHTGEKPYKCPECGKSFS QRAHLERHQRTHTGEKPYKCPEC GKSFSDPGHLVRHQRTHTGEKPY KCPECGKSFSRSDNLVRHQRTHT GEKPYKCPECGKSFSRSDHLTTH QRTHTGEKPYKCPECGKSFSRAD NLTEHQRTHTGEKPYKCPECGKS FSRSDHLTNHQRTHTGEKPTGKK TS | 1622 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_{25}X_{26}X_{27}X_{28}X_{29}X_{30}$ | 2171 |
| aggaggcag tgggaggc gga | 1074 | AGG AGG CAG TGG GAG GGC GGA | LEPGEKPYKCPECGKSFSQRAHL ERHQRTHTGEKPYKCPECGKSFS DPGHLVRHQRTHTGEKPYKCPEC GKSFSRSDNLVRHQRTHTGEKPY KCPECGKSFSRSDHLTTHQRTHT GEKPYKCPECGKSFSRADNLTEH QRTHTGEKPYKCPECGKSFSRSD HLTNHQRTHTGEKPYKCPECGKS FSRSDHLTNHQRTHTGEKPTGKK TS | 1623 | $X_1X_2X_3X_4X_5X_6X_7X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_{25}X_{26}X_{27}X_{28}X_{29}X_{30}$ | 2172 |
| gtttgaaag gaaggcaga gag | 110 | GTT TGA AAG GAA GGC AGA GAG | LEPGEKPYKCPECGKSFSRSDNL VRHQRTHTGEKPYKCPECGKSFS QLAHLRAHQRTHTGEKPYKCPEC GKSFSDPGHLVRHQRTHTGEKPY KCPECGKSFSQSSNLVRHQRTHT GEKPYKCPECGKSFSRKDNLKNH QRTHTGEKPYKCPECGKSFSQAG HLASHQRTHTGEKPYKCPECGKS FVSTSGSLVRHQRTHTGEKPTGK TS | 111 | $X_1X_2X_3X_4X_5X_6X_7X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}QLAHLRAHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSSNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RKDNLKNHX_{17}X_{18}X_{19}HX_{20}X_{21}X_{22}X_{23}X_{24}X_8X_9CX_{10}X_{11}CX_{12}X_{13}X_{14}X_{15}X_{16}QAGHLASHX_{17}X_{18}X_{19}HX_{20}X_{21}X_{22}X_{23}X_{24}X_8X_9CX_{10}X_{11}CX_{12}X_{13}X_{14}X_{15}X_{16}TSGSLVRHX_{17}X_{18}X_{19}HX_{20}X_{21}X_{22}X_{23}X_{24}X_{25}X_{26}X_{27}X_{28}X_{29}X_{30}$ | 315 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| acgtttga aggaaggc aga | 1075 | ACG GTT TGA AAG GAA GGC AGA | LEPGEKPYKCPECGKSFSQLAHL RAHQRTHTGEKPYKCPECGKSFS DPGHLVRHQRTHTGEKPYKCPEC GKSFSQSSNLVRHQRTHTGEKPY KCPECGKSFSRKDNLKNHQRTHT GEKPYKCPECGKSFSQAGHLASH QRTHTGEKPYKCPECGKSFSTSG SLVRHQRTHTGEKPYKCPECGKS FSRTDTLRDHQRTHTGEKPTGKK TS | 1624 | $X_1X_2X_3X_4X_5X_6X_7X_8X_9CX_{10}X_{11}CX_{12}X_{13}X_{14}X_{15}X_{16}QLAHLRAHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSSNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RKDNLKNH X_{17}X_{18}X_{19}HX_{20}X_{21}X_{22}X_{23}X_{24}X_8X_9CX_{10}X_{11}CX_{12}X_{13}X_{14}X_{15}X_{16}QAGHLA SHX_{17}X_{18}X_{19}HX_{20}X_{21}X_{22}X_{23}X_{24}X_8X_9CX_{10}X_{11}CX_{12}X_{13}X_{14}X_{15}X_{16}TSGS LVRHX_{17}X_{18}X_{19}HX_{20}X_{21}X_{22}X_{23}X_{24}X_8X_9CX_{10}X_{11}CX_{12}X_{13}X_{14}X_{15}X_{16}RT DTLRDHX_{17}X_{18}X_{19}HX_{20}X_{21}X_{22}X_{23}X_{24}X_{25}X_{26}X_{27}X_{28}X_{29}X_{30}$ | 2173 |
| aggacggtt tgaaggaa ggc | 1076 | AGG ACG GTT TGA AAG GAA GGC | LEPGEKPYKCPECGKSFSDPGHL VRHQRTHTGEKPYKCPECGKSFS QSSNLVRHQRTHTGEKPYKCPEC GKSFSRKDNLKNHQRTHTGEKPY KCPECGKSFSQAGHLASHQRTHT GEKPYKCPECGKSFSTSGSLVRH QRTHTGEKPYKCPECGKSFSRTD TLRDHQRTHTGEKPYKCPECGKS FSRSDHLTNHQRTHTGEKPTGKK TS | 1625 | $X_1X_2X_3X_4X_5X_6X_7X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSSNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RKDNLKNHX_{17}X_{18}X_{19}HX_{20}X_{21}X_{22}X_{23}X_{24}X_8X_9CXHHX_{11}CX_{12}X_{13}X_{14}X_{15}X_{16}QAGHLASHX_{17}X_{18}X_{19}HX_{20}X_{21}X_{22}X_{23}X_{24}X_8X_9CX_{10}X_{11}CX_{12}X_{13}X_{14}X_{15}X_{16}TSGSLV RHX_{17}X_{18}X_{19}HX_{20}X_{21}X_{22}X_{23}X_{24}X_8X_9CX_{10}X_{11}CX_{12}X_{13}X_{14}X_{15}X_{16}RTDT LRDHX_{17}X_{18}X_{19}HX_{20}X_{21}X_{22}X_{23}X_{24}X_8X_9CX_{10}X_{11}CX_{12}X_{13}X_{14}X_{15}X_{16}RS DHLTNHX_{17}X_{18}X_{19}HX_{20}X_{21}X_{22}X_{23}X_{24}X_{25}X_{26}X_{27}X_{28}X_{29}X_{30}$ | 2174 |
| cagaggacg gtttgaaag gaa | 1077 | CAG AGG ACG GTT TGA AAG GAA | LEPGEKPYKCPECGKSFSQSSNL VRHQRTHTGEKPYKCPECGKSFS RKDNLKNHQRTHTGEKPYKCPEC GKSFSQAGHLASHQRTHTGEKPY KCPECGKSFSTSGSLVRHQRTHT GEKPYKCPECGKSFSRTDTLRDH QRTHTGEKPYKCPECGKSFSRSD HLTNHQRTHTGEKPYKCPECGKS FSRADNLTEHQRTHTGEKPTGKK TS | 1626 | $X_1X_2X_3X_4X_5X_6X_7X_8X_9CX_{10}X_{11}CX_{12}X_{13}X_{14}X_{15}X_{16}QSSNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RKDNLKNHX_{17}X_{18}X_{19}HX_{20}X_{21}X_{22}X_{23}X_{24}X_8X_9CX_{10}X_{11}CX_{12}X_{13}X_{14}X_{15}X_{16}QAGHLASHX_{17}X_{18}X_{19}HX_{20}X_{21}X_{22}X_{23}X_{24}X_8X_9CX_{10}X_{11}CX_{12}X_{13}X_{14}X_{15}X_{16}TSGSLVRH X_{17}X_{18}X_{19}HX_{20}X_{21}X_{22}X_{23}X_{24}X_8X_9CX_{10}X_{11}CX_{12}X_{13}X_{14}X_{15}X_{16}RTDTLR DHX_{17}X_{18}X_{19}HX_{20}X_{21}X_{22}X_{23}X_{24}X_8X_9CX_{10}X_{11}CX_{12}X_{13}X_{14}X_{15}X_{16}RSDH LTNHX_{17}X_{18}X_{19}HX_{20}X_{21}X_{22}X_{23}X_{24}X_8X_9CX_{10}X_{11}CX_{12}X_{13}X_{14}X_{15}X_{16}RA DNLTEHX_{17}X_{18}X_{19}HX_{20}X_{21}X_{22}X_{23}X_{24}X_{25}X_{26}X_{27}X_{28}X_{29}X_{30}$ | 2175 |
| gggcgccca gggtagggc agg | 1078 | ggg CGC CCA GGG TAG GGC AGG | LEPGEKPYKCPECGKSFSRSDHL TNHQRTHTGEKPYKCPECGKSFS DPGHLVRHQRTHTGEKPYKCPEC GKSFSREDNLHTHQRTHTGEKPY KCPECGKSFSRSDKLVRHQRTHT GEKPYKCPECGKSFSTSHSLTEH QRTHTGEKPYKCPECGKSFSHTG HLLEHQRTHTGEKPYKCPECGKS FSRSDKLVRHQRTHTGEKPTGKK TS | 1627 | $X_1X_2X_3X_4X_5X_6X_7X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}REDNLHTHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRH X_{17}X_{18}X_{19}HX_{20}X_{21}X_{22}X_{23}X_{24}X_8X_9CX_{10}X_{11}CX_{12}X_{13}X_{14}X_{15}X_{16}TSHSLT EHX_{17}X_{18}X_{19}HX_{20}X_{21}X_{22}X_{23}X_{24}X_8X_9CX_{10}X_{11}CX_{12}X_{13}X_{14}X_{15}X_{16}HTGH LLEHX_{17}X_{18}X_{19}HX_{20}X_{21}X_{22}X_{23}X_{24}X_8X_9CX_{10}X_{11}CX_{12}X_{13}X_{14}X_{15}X_{16}RS DKLVRHX_{17}X_{18}X_{19}HX_{20}X_{21}X_{22}X_{23}X_{24}X_{25}X_{26}X_{27}X_{28}X_{29}X_{30}$ | 2176 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| cgcccaggg taggcaggtgg | 1079 | CGC CCA GGG TAG GGC AGG TGG | LEPGEKPYKCPECGKSFSRSDHL TTHQRTHTGEKPYKCPECGKSFS RSDHLTNHQRTHTGEKPYKCPEC GKSFSDPGHLVRHQRTHTGEKPY KCPECGKSFSREDNLHTHQRTHT GEKPYKCPECGKSFSRSDKLVRH QRTHTGEKPYKCPECGKSFSTSH SLTEHQRTHTGEKPYKCPECGKS FSHTGHLLEHQRTHTGEKPTGKK TS | 1628 | $X_1X_2X_3X_4X_5X_6X_7X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}$ $X_{19}HX_{20}X_{21}X_{22}X_{23}X_{24}X_8X_9CX_{10}X_{11}CX_{12}X_{13}X_{14}X_{15}X_{16}DPGHLVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}REDNLHTH$ $X_{17}X_{18}X_{19}HX_{20}X_{21}X_{22}X_{23}X_{24}X_8X_9CX_{10}X_{11}CX_{12}X_{13}X_{14}X_{15}X_{16}RSDKLV$ $RHX_{17}X_{18}X_{19}HX_{20}X_{21}X_{22}X_{23}X_{24}X_8X_9CX_{10}X_{11}CX_{12}X_{13}X_{14}X_{15}X_{16}TSHS$ $LTEHX_{17}X_{18}X_{19}HX_{20}X_{21}X_{22}X_{23}X_{24}X_8X_9CX_{10}X_{11}CX_{12}X_{13}X_{14}X_{15}X_{16}HT$ $GHLLEHX_{17}X_{18}X_{19}HX_{20}X_{21}X_{22}X_{23}X_{24}X_{25}X_{26}X_{27}X_{28}X_{29}X_{30}$ | 2177 |
| gggaggggcg gaggggcggg ggc | 1080 | ggg AGG GCG GAG GGC GGG GGC | LEPGEKPYKCPECGKSFSDPGHL VRHQRTHTGEKPYKCPECGKSFS RSDKLVRHQRTHTGEKPYKCPEC GKSFSDPGHLVRHQRTHTGEKPY KCPECGKSFSRSDNLVRHQRTHT GEKPYKCPECGKSFSRSDDLVRH QRTHTGEKPYKCPECGKSFSRSD HLTNHQRTHTGEKPYKCPECGKS FSRSDKLVRHQRTHTGEKPTGKK TS | 1629 | $X_1X_2X_3X_4X_5X_6X_7X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}DPGHLVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}RSDNLVRH$ $X_{17}X_{18}X_{19}HX_{20}X_{21}X_{22}X_{23}X_{24}X_8X_9CX_{10}X_{11}CX_{12}X_{13}X_{14}X_{15}X_{16}RSDDLV$ $RHX_{17}X_{18}X_{19}HX_{20}X_{21}X_{22}X_{23}X_{24}X_8X_9CX_{10}X_{11}CX_{12}X_{13}X_{14}X_{15}X_{16}RSDH$ $LTNHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DKLVRHX_{17}X_{18}X_{19}HX_{20}X_{21}X_{22}X_{23}X_{24}X_{25}X_{26}X_{27}X_{28}X_{29}X_{30}$ | 2178 |
| cggcgtgga ggcaggggag aat | 1081 | CGG CGT GGA GGA GGC AGG GGA AAT | LEPGEKPYKCPECGKSFSTTGNL TVHQRTHTGEKPYKCPECGKSFS RSDNLVRHQRTHTGEKPYKCPEC GKSFSRSDHLTNHQRTHTGEKPY KCPECGKSFSDPGHLVRHQRTHT GEKPYKCPECGKSFSQRAHLERH QRTHTGEKPYKCPECGKSFSSRR TCRAHQRTHTGEKPYKCPECGKS FSRSDKLTEHQRTHTGEKPTGKK TS | 1630 | $X_1X_2X_3X_4X_5X_6X_7X_8X_9CX_{10}X_{11}CX_{12}X_{13}X_{14}X_{15}X_{16}TTGNLTVHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}RSDHLTNHX_{17}$ $X_{18}X_{19}HX_{20}X_{21}X_{22}X_{23}X_{24}X_8X_9CX_{10}X_{11}CX_{12}X_{13}X_{14}X_{15}X_{16}DPGHLVRH$ $X_{17}X_{18}X_{19}HX_{20}X_{21}X_{22}X_{23}X_{24}X_8X_9CX_{10}X_{11}CX_{12}X_{13}X_{14}X_{15}X_{16}QRAHLE$ $RHX_{17}X_{18}X_{19}HX_{20}X_{21}X_{22}X_{23}X_{24}X_8X_9CX_{10}X_{11}CX_{12}X_{13}X_{14}X_{15}X_{16}SRRT$ $CRAHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DKLTEHX_{17}X_{18}X_{19}HX_{20}X_{21}X_{22}X_{23}X_{24}X_{25}X_{26}X_{27}X_{28}X_{29}X_{30}$ | 2179 |
| aggaaggca gagagggca ctg | 1082 | AGG AAG GCA GCA GGA AGG GCA CTG | LEPGEKPYKCPECGKSFSRNDAL TEHQRTHTGEKPYKCPECGKSFS QSGDLRRHQRTHTGEKPYKCPEC GKSFSRSDHLTNHQRTHTGEKPY KCPECGKSFSRSDNLVRHQRTHT GEKPYKCPECGKSFSQSGDLRRH QRTHTGEKPYKCPECGKSFSRKD NLKNHQRTHTGEKPYKCPECGKS FSRSDHLTNHQRTHTGEKPTGKK TS | 1631 | $X_1X_2X_3X_4X_5X_6X_7X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}$ $X_{19}HX_{20}X_{21}X_{22}X_{23}X_{24}X_8X_9CX_{10}X_{11}CX_{12}X_{13}X_{14}X_{15}X_{16}RSDHLTNHX_{17}$ $X_{18}X_{19}HX_{20}X_{21}X_{22}X_{23}X_{24}X_8X_9CX_{10}X_{11}CX_{12}X_{13}X_{14}X_{15}X_{16}RSDNLVRH$ $X_{17}X_{18}X_{19}HX_{20}X_{21}X_{22}X_{23}X_{24}X_8X_9CX_{10}X_{11}CX_{12}X_{13}X_{14}X_{15}X_{16}QSGDLR$ $RHX_{17}X_{18}X_{19}HX_{20}X_{21}X_{22}X_{23}X_{24}X_8X_9CX_{10}X_{11}CX_{12}X_{13}X_{14}X_{15}X_{16}RKDN$ $LKNHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DHLTNHX_{17}X_{18}X_{19}HX_{20}X_{21}X_{22}X_{23}X_{24}X_{25}X_{26}X_{27}X_{28}X_{29}X_{30}$ | 2180 |

TABLE 10-continued

| Column 1 Nucleotide Sequence of Target Site in HNF4α Expression Control Region | Column 3 Target sequence with space | Column 2 SEQ ID NO. (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| tagggcagg tggccgcgg cgt | TAG GGC AGG TGG CCG CGG CGT | 1083 | LEPGEKPYKCPECGKSFSRRTC RAHQRTHTGEKPYKCPECGKSFS RSDKLTEHQRTHTGEKPYKCPEC GKSFSRNDTLTEHQRTHTGEKPY KCPECGKSFSRSDHLTTHQRTHT GEKPYKCPECGKSFSRSDHLTNH QRTHTGEKPYKCPECGKSFSDPG HLVRHQRTHTGEKPYKCPECGKS FSREDNLHTHQRTHTGEKPTGKK TS | 1632 | $X_1X_2X_3X_4X_5X_6X_7X_8X_9CX_{10}X_{11}CX_{12}X_{13}X_{14}X_{15}X_{16}SRRTCRAHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLTEHX_{17}X_{18}X_{19}HX_{20}X_{21}X_{22}X_{23}X_{24}X_8X_9CX_{10}X_{11}CX_{12}X_{13}X_{14}X_{15}X_{16}RNDTLTEHX_{17}X_{18}X_{19}HX_{20}X_{21}CX_{12}X_{13}X_{14}X_{15}X_{16}RSDHLTTH_{17}X_{18}X_{19}HX_{20}X_{21}CX_{12}X_{13}X_{14}X_{15}X_{16}RSDHLTTNH_{17}X_{18}X_{19}HX_{20}X_{21}CX_{12}X_{13}X_{14}X_{15}X_{16}RSDHLTNH_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRH_{17}X_{18}X_{19}HX_{20}X_{21}X_{22}X_{23}X_{24}X_8X_9CX_{10}X_{11}CX_{12}X_{13}X_{14}X_{15}X_{16}RE_{17}DDLHTHX_{17}X_{18}X_{19}HX_{20}X_{21}X_{22}X_{23}X_{24}X_{25}X_{26}X_{27}X_{28}X_{29}X_{30}$ | 2181 |
| gggtagggc aggtggccg cgg | GGG TAG GGC AGG TGG CCG CGG | 1084 | LEPGEKPYKCPECGKSFSRSDKL TEHQRTHTGEKPYKCPECGKSFS RNDTLTEHQRTHTGEKPYKCPEC GKSFSRSDHLTTHQRTHTGEKPY KCPECGKSFSRSDHLTNHQRTHT GEKPYKCPECGKSFSDPGHLVRH QRTHTGEKPYKCPECGKSFSRED NLHTHQRTHTGEKPYKCPECGKS FSRSDKLVRHQRTHTGEKPTGKK TS | 1633 | $X_1X_2X_3X_4X_5X_6X_7X_8X_9CX_{10}X_{11}CX_{12}X_{13}X_{14}X_{15}X_{16}RSDKLTEHX_{17}X_{18}X_{19}HX_{20}X_{21}X_{22}X_{23}X_{24}X_8X_9CX_{10}X_{11}CX_{12}X_{13}X_{14}X_{15}X_{16}RNDTLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}REDNLHTHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_{25}X_{26}X_{27}X_{28}X_{29}X_{30}$ | 2182 |
| ccagggtag ggctggtgg ccg | CCA GGG TAG GGC TGG TGG CCG | 1085 | LEPGEKPYKCPECGKSFSRNDTL TEHQRTHTGEKPYKCPECGKSFS RSDHLTTHQRTHTGEKPYKCPEC GKSFSRSDHLTNHQRTHTGEKPY KCPECGKSFSDPGHLVRHQRTHT GEKPYKCPECGKSFSREDNLHTH QRTHTGEKPYKCPECGKSFSRSD KLVRHQRTHTGEKPYKCPECGKS FSTSHSLTEHQRTHTGEKPTGKK TS | 1634 | $X_1X_2X_3X_4X_5X_6X_7X_8X_9CX_{10}X_{11}CX_{12}X_{13}X_{14}X_{15}X_{16}RNDTLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}REDNLHTHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_{25}X_{26}X_{27}X_{28}X_{29}X_{30}$ | 2183 |
| gcggagggc ggggccctt cgg | GCG GAG GGC GGG GCC CTT CGG | 1086 | LEPGEKPYKCPECGKSFSRSDKL TEHQRTHTGEKPYKCPECGKSFS TTGALTEHQRTHTGEKPYKCPEC GKSFSDPGHLVRHQRTHTGEKPY KCPECGKSFSRSDKLVRHQRTHT GEKPYKCPECGKSFSDPGHLVRH QRTHTGEKPYKCPECGKSFSRSD NLVRHQRTHTGEKPYKCPECGKS FSRSDDLVRHQRTHTGEKPTGKK TS | 1635 | $X_1X_2X_3X_4X_5X_6X_7X_8X_9CX_{10}X_{11}CX_{12}X_{13}X_{14}X_{15}X_{16}RSDKLTEHX_{17}X_{18}X_{19}HX_{20}X_{21}X_{22}X_{23}X_{24}X_8X_9CX_{10}X_{11}CX_{12}X_{13}X_{14}X_{15}X_{16}TTGALTEHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDDLVRHX_{17}X_{18}X_{19}HX_{20}X_{21}X_{22}X_{23}X_{24}X_{25}X_{26}X_{27}X_{28}X_{29}X_{30}$ | 2184 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gaaaggaag gcagagagg gca | 1087 | GAA AGG AAG GCA gag AGG GCA | LEPGEKPYKCPECGKSFSQSGDL RRHQRTHTGEKPYKCPECGKSFS RSDHLTNHQRTHTGEKPYKCPEC GKSFSRSDNLVRHQRTHTGEKPY KCPECGKSFSQSGDLRRHQRTHT GEKPYKCPECGKSFSRDNLKNH QRTHTGEKPYKCPECGKSFSRSD HLTNHQRTHTGEKPYKCPECGKS FSQSSNLVRHQRTHTGEKPTGKK TS | 1636 | $X_1X_2X_3X_4X_5X_6X_7X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRH X_{17}X_{18}X_{19}HX_{20}X_{21}X_{22}X_{23}X_{24}X_8X_9CX_{10}X_{11}CX_{12}X_{13}X_{14}X_{15}X_{16}RKDNLK NHX_{17}X_{18}X_{19}HX_{20}X_{21}X_{22}X_{23}X_{24}X_8X_9CX_{10}X_{11}CX_{12}X_{13}X_{14}X_{15}X_{16}RSDH LTNHX_{17}X_{18}X_{19}HX_{20}X_{21}X_{22}X_{23}X_{24}X_8X_9CX_{10}X_{11}CX_{12}X_{13}X_{14}X_{15}X_{16}QS SNLVRHX_{17}X_{18}X_{19}HX_{20}X_{21}X_{22}X_{23}X_{24}X_{25}X_{26}X_{27}X_{28}X_{29}X_{30}$ | 2185 |
| ggcagtggg aggcggagg ggc | 1088 | GGC AGT ggg AGG GCG GAG GGC | LEPGEKPYKCPECGKSFSDPGHL VRHQRTHTGEKPYKCPECGKSFS RSDNLVRHQRTHTGEKPYKCPEC GKSFSRSDDLVRHQRTHTGEKPY KCPECGKSSRSDHLVTNHQRTHT GEKPYKCPECGKSFSRSDKLVRH QRTHTGEKPYKCPECGKSFSHRT TLTNHQRTHTGEKPYKCPECGKS FSDPGHLVRHQRTHTGEKPTGKK TS | 1637 | $X_1X_2X_3X_4X_5X_6X_7X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDDLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNH X_{17}X_{18}X_{19}HX_{20}X_{21}X_{22}X_{23}X_{24}X_8X_9CX_{10}X_{11}CX_{12}X_{13}X_{14}X_{15}X_{16}RSDKLV RHX_{17}X_{18}X_{19}HX_{20}X_{21}X_{22}X_{23}X_{24}X_8X_9CX_{10}X_{11}CX_{12}X_{13}X_{14}X_{15}X_{16}HRTT LTNHX_{17}X_{18}X_{19}HX_{20}X_{21}X_{22}X_{23}X_{24}X_8X_9CX_{10}X_{11}CX_{12}X_{13}X_{14}X_{15}X_{16}DP GHLVRHX_{17}X_{18}X_{19}HX_{20}X_{21}X_{22}X_{23}X_{24}X_{25}X_{26}X_{27}X_{28}X_{29}X_{30}$ | 2186 |
| agtggaggg gcgagaggc ggg | 1089 | AGT ggg AGG GCG GAG GGC GGG | LEPGEKPYKCPECGKSFSRSDKL VRHQRTHTGEKPYKCPECGKSFS DPGHLVRHQRTHTGEKPYKCPEC GKSFSRSDKLVRHQRTHTGEKPY KCPECGKSFSRSDDLVRHQRTHT GEKPYKCPECGKSFSRSDHLTNH QRTHTGEKPYKCPECGKSFSRSD KLVRHQRTHTGEKPYKCPECGKS FSHRTTLTNHQRTHTGEKPTGKK TS | 1638 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDDLVRH X_{17}X_{18}X_{19}HX_{20}X_{21}X_{22}X_{23}X_{24}X_8X_9CX_{10}X_{11}CX_{12}X_{13}X_{14}X_{15}X_{16}RSDHLT NHX_{17}X_{18}X_{19}HX_{20}X_{21}X_{22}X_{23}X_{24}X_8X_9CX_{10}X_{11}CX_{12}X_{13}X_{14}X_{15}X_{16}RSDK LVRHX_{17}X_{18}X_{19}HX_{20}X_{21}X_{22}X_{23}X_{24}X_8X_9CX_{10}X_{11}CX_{12}X_{13}X_{14}X_{15}X_{16}HR TTLTNHX_{17}X_{18}X_{19}HX_{20}X_{21}X_{22}X_{23}X_{24}X_{25}X_{26}X_{27}X_{28}X_{29}X_{30}$ | 2187 |
| agggcggag ggcgggggc ctt | 1090 | AGG GCG GAG GGC GGG GGC CTT | LEPGEKPYKCPECGKSFSTTGAL TEHQRTHTGEKPYKCPECGKSFS DPGHLVRHQRTHTGEKPYKCPEC GKSFSRSDKLVRHQRTHTGEKPY KCPECGKSFSDPGHLVRHQRTHT GEKPYKCPECGKSFSRSDNLVRH QRTHTGEKPYKCPECGKSFSRSD DLVRHQRTHTGEKPYKCPECGKS FSRSDHLTNHQRTHTGEKPTGKK TS | 1639 | $X_1X_2X_3X_4X_5X_6X_7X_8X_9CX_{10}X_{11}CX_{12}X_{13}X_{14}X_{15}X_{16}TTGALTEHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRH X_{17}X_{18}X_{19}HX_{20}X_{21}X_{22}X_{23}X_{24}X_8X_9CX_{10}X_{11}CX_{12}X_{13}X_{14}X_{15}X_{16}RSDNLV RHX_{17}X_{18}X_{19}HX_{20}X_{21}X_{22}X_{23}X_{24}X_8X_9CX_{10}X_{11}CX_{12}X_{13}X_{14}X_{15}X_{16}RSDD LVRHX_{17}X_{18}X_{19}HX_{20}X_{21}X_{22}X_{23}X_{24}X_8X_9CX_{10}X_{11}CX_{12}X_{13}X_{14}X_{15}X_{16}RS DHLTNHX_{17}X_{18}X_{19}HX_{20}X_{21}X_{22}X_{23}X_{24}X_{25}X_{26}X_{27}X_{28}X_{29}X_{30}$ | 2188 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| aaggcagag aggcactg gga | 1091 | AAG GCA gag gag GCA CTG GGA | LEPGEKPYKCPECGKSFSQRAHL ERHQRTHTGEKPYKCPECGKSFS RNDALTEHQRTHTGEKPYKCPEC GKSFSQSGDLRRHQRTHTGEKPY KCPECGKSFSRSDHLTNHQRTHT GEKPYKCPECGKSFSRSDNLVRH QRTHTGEKPYKCPECGKSFSQSG DLRRHQRTHTGEKPYKCPECGKS FSRKDNLKNHQRTHTGEKPTGKK TS | 1640 | $X_1X_2X_3X_4X_5X_6X_7X_8X_9CX_{10}X_{11}CX_{12}X_{13}X_{14}X_{15}X_{16}QRAHLERHX_{17}X_{18}X_{19}$ $HX_{20}X_{21}X_{22}X_{23}X_{24}X_8X_9CX_{10}X_{11}CX_{12}X_{13}X_{14}X_{15}X_{16}RNDALTEHX_{17}X_{18}$ $X_{19}HX_{20}X_{21}X_{22}X_{23}X_{24}X_8X_9CX_{10}X_{11}CX_{12}X_{13}X_{14}X_{15}X_{16}QSGDLRRHX_{17}$ $X_{18}X_{19}HX_{20}X_{21}X_{22}X_{23}X_{24}X_8X_9CX_{10}X_{11}CX_{12}X_{13}X_{14}X_{15}X_{16}RSDHLTNH$ $X_{17}X_{18}X_{19}HX_{20}X_{21}X_{22}X_{23}X_{24}X_8X_9CX_{10}X_{11}CX_{12}X_{13}X_{14}X_{15}X_{16}RSDNLV$ $RHX_{17}X_{18}X_{19}HX_{20}X_{21}X_{22}X_{23}X_{24}X_8X_9CX_{10}X_{11}CX_{12}X_{13}X_{14}X_{15}X_{16}QSGD$ $LRRHX_{17}X_{18}X_{19}HX_{20}X_{21}X_{22}X_{23}X_{24}X_8X_9CX_{10}X_{11}CX_{12}X_{13}X_{14}X_{15}X_{16}RK$ $DNLKNHX_{17}X_{18}X_{19}HX_{20}X_{21}X_{22}X_{23}X_{24}X_{25}X_{26}X_{27}X_{28}X_{29}X_{30}$ | 2189 |
| ccgcggcgt ggaggcagg gag | 102 | CCG CGG CGT GGA GGC AGG GAG | LEPGEKPYKCPECGKSFSRSDNL VRHQRTHTGEKPYKCPECGKSFS RSDHLTNHQRTHTGEKPYKCPEC GKSFSDPGHLVRHQRTHTGEKPY KCPECGKSFSQRAHLERHQRTHT GEKPYKCPECGKSFSSRRTCRAH QRTHTGEKPYKCPECGKSFSRSD KLTEHQRTHTGEKPYKCPECGKS FSRNDTLTEHQRTHTGEKPTGKK TS | 103 | $X_1X_2X_3X_4X_5X_6X_7X_8X_9CX_{10}X_{11}CX_{12}X_{13}X_{14}X_{15}X_{16}RSDNLVRHX_{17}X_{18}X_{19}$ $HX_{20}X_{21}X_{22}X_{23}X_{24}X_8X_9CX_{10}X_{11}CX_{12}X_{13}X_{14}X_{15}X_{16}RSDHLTNHX_{17}X_{18}$ $X_{19}HX_{20}X_{21}X_{22}X_{23}X_{24}X_8X_9CX_{10}X_{11}CX_{12}X_{13}X_{14}X_{15}X_{16}DPGHLVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}QRAHLERH$ $X_{17}X_{18}X_{19}HX_{20}X_{21}X_{22}X_{23}X_{24}X_8X_9CX_{10}X_{11}CX_{12}X_{13}X_{14}X_{15}X_{16}SRRTCR$ $AHX_{17}X_{18}X_{19}HX_{20}X_{21}X_{22}X_{23}X_{24}X_8X_9CX_{10}X_{11}CX_{12}X_{13}X_{14}X_{15}X_{16}RSDK$ $LTEHX_{17}X_{18}X_{19}HX_{20}X_{21}X_{22}X_{23}X_{24}X_8X_9CX_{10}X_{11}CX_{12}X_{13}X_{14}X_{15}X_{16}RN$ $DTLTEHX_{17}X_{18}X_{19}HX_{20}X_{21}X_{22}X_{23}X_{24}X_{25}X_{26}X_{27}X_{28}X_{29}X_{30}$ | 313 |
| cgtgaggc agggagaat gcg | 1092 | CGT GAG GGC gag AGG AAT GCG | LEPGEKPYKCPECGKSFSRSDDL VRHQRTHTGEKPYKCPECGKSFS TTGNLTVHQRTHTGEKPYKCPEC GKSFSRSDNLVRHQRTHTGEKPY KCPECGKSFSRSDHLTNHQRTHT GEKPYKCPECGKSFSDPGHLVRH QRTHTGEKPYKCPECGKSFSQRA HLERHQRTHTGEKPYKCPECGKS FSSRRTCRAHQRTHTGEKPTGKK TS | 1641 | $X_1X_2X_3X_4X_5X_6X_7X_8X_9CX_{10}X_{11}CX_{12}X_{13}X_{14}X_{15}X_{16}RSDDLVRHX_{17}X_{18}X_{19}$ $HX_{20}X_{21}X_{22}X_{23}X_{24}X_8X_9CX_{10}X_{11}CX_{12}X_{13}X_{14}X_{15}X_{16}TTGNLTVHX_{17}X_{18}$ $X_{19}HX_{20}X_{21}X_{22}X_{23}X_{24}X_8X_9CX_{10}X_{11}CX_{12}X_{13}X_{14}X_{15}X_{16}RSDNLVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}RSDHLTNH$ $X_{17}X_{18}X_{19}HX_{20}X_{21}X_{22}X_{23}X_{24}X_8X_9CX_{10}X_{11}CX_{12}X_{13}X_{14}X_{15}X_{16}DPGHLV$ $RHX_{17}X_{18}X_{19}HX_{20}X_{21}X_{22}X_{23}X_{24}X_8X_9CX_{10}X_{11}CX_{12}X_{13}X_{14}X_{15}X_{16}QRAH$ $LERHX_{17}X_{18}X_{19}HX_{20}X_{21}X_{22}X_{23}X_{24}X_8X_9CX_{10}X_{11}CX_{12}X_{13}X_{14}X_{15}X_{16}SR$ $RTCRAHX_{17}X_{18}X_{19}HX_{20}X_{21}X_{22}X_{23}X_{24}X_{25}X_{26}X_{27}X_{28}X_{29}X_{30}$ | 2190 |
| gcagaagg gcactggga gga | 1093 | GCA gag AGG GCA CTG GGA GGA | LEPGEKPYKCPECGKSFSQRAHL ERHQRTHTGEKPYKCPECGKSFS QRAHLERHQRTHTGEKPYKCPEC GKSFSRNDALTEHQRTHTGEKPY KCPECGKSFSQSGDLRRHQRTHT GEKPYKCPECGKSFSRSDHLTNH QRTHTGEKPYKCPECGKSFSRSD NLVRHQRTHTGEKPYKCPECGKS FSQSGDLRRHQRTHTGEKPTGKK TS | 1642 | $X_1X_2X_3X_4X_5X_6X_7X_8X_9CX_{10}X_{11}CX_{12}X_{13}X_{14}X_{15}X_{16}QRAHLERHX_{17}X_{18}X_{19}$ $HX_{20}X_{21}X_{22}X_{23}X_{24}X_8X_9CX_{10}X_{11}CX_{12}X_{13}X_{14}X_{15}X_{16}QRAHLERHX_{17}X_{18}$ $X_{19}HX_{20}X_{21}X_{22}X_{23}X_{24}X_8X_9CX_{10}X_{11}CX_{12}X_{13}X_{14}X_{15}X_{16}RNDALTEHX_{17}$ $X_{18}X_{19}HX_{20}X_{21}X_{22}X_{23}X_{24}X_8X_9CX_{10}X_{11}CX_{12}X_{13}X_{14}X_{15}X_{16}QSGDLRRH$ $X_{17}X_{18}X_{19}HX_{20}X_{21}X_{22}X_{23}X_{24}X_8X_9CX_{10}X_{11}CX_{12}X_{13}X_{14}X_{15}X_{16}RSDHLT$ $NHX_{17}X_{18}X_{19}HX_{20}X_{21}X_{22}X_{23}X_{24}X_8X_9CX_{10}X_{11}CX_{12}X_{13}X_{14}X_{15}X_{16}RSDN$ $LVRHX_{17}X_{18}X_{19}HX_{20}X_{21}X_{22}X_{23}X_{24}X_8X_9CX_{10}X_{11}CX_{12}X_{13}X_{14}X_{15}X_{16}QS$ $GDLRRHX_{17}X_{18}X_{19}HX_{20}X_{21}X_{22}X_{23}X_{24}X_{25}X_{26}X_{27}X_{28}X_{29}X_{30}$ | 2191 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gagagggca ctgggagga ggc | 1094 | gag AGG GCA CTG GGA GGA GGC | LEPGEKPYKCPECGKSFSDPGHL VRHQRTHTGEKPYKCPECGKSFS QRAHLERHQRTHTGEKPYKCPEC GKSFSQRAHLERHQRTHTGEKPY KCPECGKSFSRNDALTEHQRTHT GEKPYKCPECGKSFSQSGDLRRH QRTHTGEKPYKCPECGKSFSRSD HLTNHQRTHTGEKPYKCPECGKS FSRSDNLVRHQRTHTGEKPTGKK TS | 1643 | $X_1X_2X_3X_4X_5X_6X_7X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEH X_{17}X_{18}X_{19}HX_{20}X_{21}X_{22}X_{23}X_{24}X_8X_9CX_{10}X_{11}CX_{12}X_{13}X_{14}X_{15}X_{16}QSGDLR RHX_{17}X_{18}X_{19}HX_{20}X_{21}X_{22}X_{23}X_{24}X_8X_9CX_{10}X_{11}CX_{12}X_{13}X_{14}X_{15}X_{16}RSDH LTNHX_{17}X_{18}X_{19}HX_{20}X_{21}X_{22}X_{23}X_{24}X_8X_9CX_{10}X_{11}CX_{12}X_{13}X_{14}X_{15}X_{16}RS DNLVRHX_{17}X_{18}X_{19}HX_{20}X_{21}X_{22}X_{23}X_{24}X_{25}X_{26}X_{27}X_{28}X_{29}X_{30}$ | 2192 |
| aggtgccg cggcgtgga ggc | 1095 | AGG TGG CCG CGT GGA GGC | LEPGEKPYKCPECGKSFSDPGHL VRHQRTHTGEKPYKCPECGKSFS QRAHLERHQRTHTGEKPYKCPEC GKSFSSRRTCRAHQRTHTGEKPY KCPECGKSFSRSDKLTEHQRTHT GEKPYKCPECGKSFSRNDTLTEH QRTHTGEKPYKCPECGKSFSRSD HLITTHQRTHTGEKPYKCPECGKS FSRSDHLTNHQRTHTGEKPTGKK TS | 1644 | $X_1X_2X_3X_4X_5X_6X_7X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}SRRTCRAHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLTEH X_{17}X_{18}X_{19}HX_{20}X_{21}X_{22}X_{23}X_{24}X_8X_9CX_{10}X_{11}CX_{12}X_{13}X_{14}X_{15}X_{16}RNDTLT EHX_{17}X_{18}X_{19}HX_{20}X_{21}X_{22}X_{23}X_{24}X_8X_9CX_{10}X_{11}CX_{12}X_{13}X_{14}X_{15}X_{16}RSDH LTTHX_{17}X_{18}X_{19}HX_{20}X_{21}X_{22}X_{23}X_{24}X_8X_9CX_{10}X_{11}CX_{12}X_{13}X_{14}X_{15}X_{16}RS DHLTNHX_{17}X_{18}X_{19}HX_{20}X_{21}X_{22}X_{23}X_{24}X_{25}X_{26}X_{27}X_{28}X_{29}X_{30}$ | 2193 |
| tggccgcgg cgtggaggc agg | 1096 | TGG CCG CGT GGA GGC AGG | LEPGEKPYKCPECGKSFSRSDHL TNHQRTHTGEKPYKCPECGKSFS DPGHLVRHQRTHTGEKPYKCPEC GKSFSQRAHLERHQRTHTGEKPY KCPECGKSFSSRRTCRAHQRTHT GEKPYKCPECGKSFSRSDKLTEH QRTHTGEKPYKCPECGKSFSRND TLTEHQRTHTGEKPYKCPECGKS FSRSDHLTTHQRTHTGEKPTGKK TS | 1645 | $X_1X_2X_3X_4X_5X_6X_7X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}SRRTCRAH X_{17}X_{18}X_{19}HX_{20}X_{21}X_{22}X_{23}X_{24}X_8X_9CX_{10}X_{11}CX_{12}X_{13}X_{14}X_{15}X_{16}RSDKLT EHX_{17}X_{18}X_{19}HX_{20}X_{21}X_{22}X_{23}X_{24}X_8X_9CX_{10}X_{11}CX_{12}X_{13}X_{14}X_{15}X_{16}RNDT LTEHX_{17}X_{18}X_{19}HX_{20}X_{21}X_{22}X_{23}X_{24}X_8X_9CX_{10}X_{11}CX_{12}X_{13}X_{14}X_{15}X_{16}RS DHLTTHX_{17}X_{18}X_{19}HX_{20}X_{21}X_{22}X_{23}X_{24}X_{25}X_{26}X_{27}X_{28}X_{29}X_{30}$ | 2194 |
| ggcaggtgg ccgggcgt gga | 1097 | GGC AGG TGG CCG CGT GGA | LEPGEKPYKCPECGKSFSQRAHL ERHQRTHTGEKPYKCPECGKSFS SRRTCRAHQRTHTGEKPYKCPEC GKSFSRSDKLTEHQRTHTGEKPY KCPECGKSFSRNDTLTEHQRTHT GEKPYKCPECGKSFSRSDHLTTH QRTHTGEKPYKCPECGKSFSRSD HLTNHQRTHTGEKPYKCPECGKS FSDPGHLVRHQRTHTGEKPTGKK TS | 1646 | $X_1X_2X_3X_4X_5X_6X_7X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}SRRTCRAHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLTEHX_{17}X_{18}X_{19}HX_{20}X_{21}X_{22}X_{23}X_{24}X_8X_9CX_{10}X_{11}CX_{12}X_{13}X_{14}X_{15}X_{16}RNDTLTEH X_{17}X_{18}X_{19}HX_{20}X_{21}X_{22}X_{23}X_{24}X_8X_9CX_{10}X_{11}CX_{12}X_{13}X_{14}X_{15}X_{16}RSDH LTTHX_{17}X_{18}X_{19}HX_{20}X_{21}X_{22}X_{23}X_{24}X_8X_9CX_{10}X_{11}CX_{12}X_{13}X_{14}X_{15}X_{16}RSDH LTNHX_{17}X_{18}X_{19}HX_{20}X_{21}X_{22}X_{23}X_{24}X_8X_9CX_{10}X_{11}CX_{12}X_{13}X_{14}X_{15}X_{16}dP GHLVRHX_{17}X_{18}X_{19}HX_{20}X_{21}X_{22}X_{23}X_{24}X_{25}X_{26}X_{27}X_{28}X_{29}X_{30}$ | 2195 |

TABLE 10-continued

| Column 1 Nucleotide Sequence of Target Site in HNF4α Expression Control Region | Column 2 Target sequence with space | Column 3 Target sequence (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gggagcagg gagatgcg act | GGA GGC AGG gag AAT gcg ACT | 1098 | LEPGEKPYKCPECGKSFSTHLDL IRHQRTHTGEKPYKCPECGKSFS RSDDLVRHQRTHTGEKPYKCPEC GKSFSTTGNLTVHQRTHTGEKPY KCPECGKSFSRSDNLVRHQRTHT GEKPYKCPECGKSFSRSDHLTNH QRTHTGEKPYKCPECGKSFSDPG HLVRHQRTHTGEKPYKCPECGKS FSQRAHLERHQRTHTGEKPTGKK TS | 1647 | $X_1X_2X_3X_4X_5X_6X_7X_8X_9CX_{10}X_{11}CX_{12}X_{13}X_{14}X_{15}X_{16}$THLDLIRH$X_{17}X_{18}X_{19}$HX$_{20}X_{21}X_{22}X_{23}X_{24}X_8X_9$CX$_{10}X_{11}$CX$_{12}X_{13}X_{14}X_{15}X_{16}$RSDDLVRH$X_{17}X_{18}$ X$_{19}$HX$_{20}X_{21}X_{22}X_{23}X_{24}X_8X_9$CX$_{10}X_{11}$CX$_{12}X_{13}X_{14}X_{15}X_{16}$TTGNLTVH$X_{17}$ X$_{18}X_{19}$HX$_{20}X_{21}X_{22}X_{23}X_{24}X_8X_9$CX$_{10}X_{11}$CX$_{12}X_{13}X_{14}X_{15}X_{16}$RSDNLVRH X$_{17}X_{18}X_{19}$HX$_{20}X_{21}X_{22}X_{23}X_{24}X_8X_9$CX$_{10}X_{11}$CX$_{12}X_{13}X_{14}X_{15}X_{16}$RSDHLT NH$X_{17}X_{18}X_{19}$HX$_{20}X_{21}X_{22}X_{23}X_{24}X_8X_9$CX$_{10}X_{11}$CX$_{12}X_{13}X_{14}X_{15}X_{16}$DPGH LVRH$X_{17}X_{18}X_{19}$HX$_{20}X_{21}X_{22}X_{23}X_{24}X_8X_9$CX$_{10}X_{11}$CX$_{12}X_{13}X_{14}X_{15}X_{16}$QR AHLERH$X_{17}X_{18}X_{19}$HX$_{20}X_{21}X_{22}X_{23}X_{24}X_{25}X_{26}X_{27}X_{28}X_{29}X_{30}$ | 2196 |
| gcactggga ggaggcagt ggg | GCA CTG GGA GGA GGC AGT GGG | 1099 | LEPGEKPYKCPECGKSFSRSDKL VRHQRTHTGEKPYKCPECGKSFS HRTTLTNHQRTHTGEKPYKCPEC GKSFSDPGHLVRHQRTHTGEKPY KCPECGKSFSQRAHLERHQRTHT GEKPYKCPECGKSFSRAHLERH QRTHQRTHTGEKPYKCPECGKSFSRND ALTEHQRTHTGEKPYKCPECGKS FSQSGDLRRHQRTHTGEKPTGKK TS | 1648 | $X_1X_2X_3X_4X_5X_6X_7X_8X_9$CX$_{10}X_{11}$CX$_{12}X_{13}X_{14}X_{15}X_{16}$RSDKLVRH$X_{17}X_{18}X_{19}$ HX$_{20}X_{21}X_{22}X_{23}X_{24}X_8X_9$CX$_{10}X_{11}$CX$_{12}X_{13}X_{14}X_{15}X_{16}$DPGHLVRH$X_{17}X_{18}$ X$_{19}X_{18}X_{19}$HX$_{20}X_{21}X_{22}X_{23}X_{24}X_8X_9$CX$_{10}X_{11}$CX$_{12}X_{13}X_{14}X_{15}X_{16}$QRAHLERH X$_{17}X_{18}X_{19}$HX$_{20}X_{21}X_{22}X_{23}X_{24}X_8X_9$CX$_{10}X_{11}$CX$_{12}X_{13}X_{14}X_{15}X_{16}$QRAHLE RH$X_{17}X_{18}X_{19}$HX$_{20}X_{21}X_{22}X_{23}X_{24}X_8X_9$CX$_{10}X_{11}$CX$_{12}X_{13}X_{14}X_{15}X_{16}$RNDA LTEH$X_{17}X_{18}X_{19}$HX$_{20}X_{21}X_{22}X_{23}X_{24}X_8X_9$CX$_{10}X_{11}$CX$_{12}X_{13}X_{14}X_{15}X_{16}$QS GDLRRH$X_{17}X_{18}X_{19}$HX$_{20}X_{21}X_{22}X_{23}X_{24}X_{25}X_{26}X_{27}X_{28}X_{29}X_{30}$ | 2197 |
| ggagcagt gggaggcg gag | GGA AGT GGG AGG GCG GAG | 1100 | LEPGEKPYKCPECGKSFSRSDNL VRHQRTHTGEKPYKCPECGKSFS RSDDLVRHQRTHTGEKPYKCPEC GKSFSRSDHLTNHQRTHTGEKPY KCPECGKSFSRSDKLVRHQRTHT GEKPYKCPECGKSFSHRTTLTNH QRTHTGEKPYKCPECGKSFSDPG HLVRHQRTHTGEKPYKCPECGKS FSQRAHLERHQRTHTGEKPTGKK TS | 1649 | $X_1X_2X_3X_4X_5X_6X_7X_8X_9$CX$_{10}X_{11}$CX$_{12}X_{13}X_{14}X_{15}X_{16}$RSDNLVRH$X_{17}X_{18}X_{19}$ HX$_{20}X_{21}X_{22}X_{23}X_{24}X_8X_9$CX$_{10}X_{11}$CX$_{12}X_{13}X_{14}X_{15}X_{16}$RSDDLVRH$X_{17}X_{18}$ X$_{19}$HX$_{20}X_{21}X_{22}X_{23}X_{24}X_8X_9$CX$_{10}X_{11}$CX$_{12}X_{13}X_{14}X_{15}X_{16}$RSDHLTNH$X_{17}$ X$_{18}X_{19}$HX$_{20}X_{21}X_{22}X_{23}X_{24}X_8X_9$CX$_{10}X_{11}$CX$_{12}X_{13}X_{14}X_{15}X_{16}$RSDKLVRH X$_{17}X_{18}X_{19}$HX$_{20}X_{21}X_{22}X_{23}X_{24}X_8X_9$CX$_{10}X_{11}$CX$_{12}X_{13}X_{14}X_{15}X_{16}$HRTTLT NH$X_{17}X_{18}X_{19}$HX$_{20}X_{21}X_{22}X_{23}X_{24}X_8X_9$CX$_{10}X_{11}$CX$_{12}X_{13}X_{14}X_{15}X_{16}$DPGH LVRH$X_{17}X_{18}X_{19}$HX$_{20}X_{21}X_{22}X_{23}X_{24}X_8X_9$CX$_{10}X_{11}$CX$_{12}X_{13}X_{14}X_{15}X_{16}$QR AHLERH$X_{17}X_{18}X_{19}$HX$_{20}X_{21}X_{22}X_{23}X_{24}X_{25}X_{26}X_{27}X_{28}X_{29}X_{30}$ | 2198 |
| agggcactg gggaggagc agt | AGG GCA CTG GGA GGC AGT | 1101 | LEPGEKPYKCPECGKSFSHRTTL TNHQRTHTGEKPYKCPECGKSFS DPGHLVRHQRTHTGEKPYKCPEC GKSFSQRAHLERHQRTHTGEKPY KCPECGKSFSRNDALTEH QRTHTGEKPYKCPECGKSFSQSG DLRRHQRTHTGEKPYKCPECGKS FSRSDHLTNHQRTHTGEKPTGKK TS | 1650 | $X_1X_2X_3X_4X_5X_6X_7X_8X_9$CX$_{10}X_{11}$CX$_{12}X_{13}X_{14}X_{15}X_{16}$HRTTLTNH$X_{17}X_{18}X_{19}$ HX$_{20}X_{21}X_{22}X_{23}X_{24}X_8X_9$CX$_{10}X_{11}$CX$_{12}X_{13}X_{14}X_{15}X_{16}$DPGHLVRH$X_{17}X_{18}$ X$_{19}X_{18}X_{19}$HX$_{20}X_{21}X_{22}X_{23}X_{24}X_8X_9$CX$_{10}X_{11}$CX$_{12}X_{13}X_{14}X_{15}X_{16}$QRAHLERH X$_{17}X_{18}X_{19}$HX$_{20}X_{21}X_{22}X_{23}X_{24}X_8X_9$CX$_{10}X_{11}$CX$_{12}X_{13}X_{14}X_{15}X_{16}$RNDALT EH$X_{17}X_{18}X_{19}$HX$_{20}X_{21}X_{22}X_{23}X_{24}X_8X_9$CX$_{10}X_{11}$CX$_{12}X_{13}X_{14}X_{15}X_{16}$QSGD LRRH$X_{17}X_{18}X_{19}$HX$_{20}X_{21}X_{22}X_{23}X_{24}X_8X_9$CX$_{10}X_{11}$CX$_{12}X_{13}X_{14}X_{15}X_{16}$RS DHLTNH$X_{17}X_{18}X_{19}$HX$_{20}X_{21}X_{22}X_{23}X_{24}X_{25}X_{26}X_{27}X_{28}X_{29}X_{30}$ | 2199 |

TABLE 10-continued

| Column 1 Nucleotide Sequence of Target Site in HNF4α Expression Control Region | Column 2 Target sequence with space | Column 3 Target sequence | Column 4 Amino acid Sequence of Zinc Finger DNA Binding Domain Polypeptides Targeting the Target Site in Column 1 | Column 5 SEQ ID NO. (corresponds to sequences in Columns 1 and 3) | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| ctgggagga ggcagtggg agg | CTG GGA GGA GGC AGT ggg AGG | | LEPGEKPYKCPECGKSFSRSDHL TNHQRTHTGEKPYKCPECGKSFS RSDKLVRHQRTHTGEKPYKCPEC GKSFSHRTTLTNHQRTHTGEKPY KCPECGKSFSDPGHLVRHQRTHT GEKPYKCPECGKSFSQRAHLERH QRTHTGEKPYKCPECGKSFSQRA HLERHQRTHTGEKPYKCPECGKS FSRNDALTEHQRTHTGEKPTGKK TS | 1102 | $X_1X_2X_3X_4X_5X_6X_7X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}HRTTLTNHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_{25}X_{26}X_{27}X_{28}X_{29}X_{30}$ | 2200 |
| ggtgggcgc ccaggtag ggc | GGT ggg CGC CCA GGG TAG GGC | | LEPGEKPYKCPECGKSFSDPGHL VRHQRTHTGEKPYKCPECGKSFS REDNLHTHQRTHTGEKPYKCPEC GKSFSRSDKLVRHQRTHTGEKPY KCPECGKSFSTSHSLTEHQRTHT GEKPYKCPECGKSFSHTGHLLEH QRTHTGEKPYKCPECGKSFSRSD KLVRHQRTHTGEKPYKCPECGKS FSTSGHLVRHQRTHTGEKPTGKK TS | 1103 | $X_1X_2X_3X_4X_5X_6X_7X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}REDNLHTHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}HTGHLLEHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_{25}X_{26}X_{27}X_{28}X_{29}X_{30}$ | 2201 |
| cgggtggg cgcccaggg tag | CGG GGT ggg CGC CCA GGG TAG | | LEPGEKPYKCPECGKSFSREDNL HTHQRTHTGEKPYKCPECGKSFS RSDKLVRHQRTHTGEKPYKCPEC GKSFSTSHSLTEHQRTHTGEKPY KCPECGKSFSHTGHLLEHQRTHT GEKPYKCPECGKSFSRSDKLVRH QRTHTGEKPYKCPECGKSFSTSG HLVRHQRTHTGEKPYKCPECGKS FSRSDKLTEHQRTHTGEKPTGKK TS | 1104 | $X_1X_2X_3X_4X_5X_6X_7X_8X_9CX_{10}X_{11}CX_{12}X_{13}X_{14}X_{15}X_{16}REDNLHTHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}HTGHLLEHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLTEHX_{17}X_{18}X_{19}HX_{20}X_{21}X_{22}X_{23}X_{24}X_{25}X_{26}X_{27}X_{28}X_{29}X_{30}$ | 2202 |
| ggcggggc cttcggggt ggg | GGC GGG GGC CTT CGG GGT GGG | | LEPGEKPYKCPECGKSFSRSDKL VRHQRTHTGEKPYKCPECGKSFS TSGHLVRHQRTHTGEKPYKCPEC GKSFSRSDKLTEHQRTHTGEKPY KCPECGKSFSTTGALTEHQRTHT GEKPYKCPECGKSFSDPGHLVRH QRTHTGEKPYKCPECGKSFSRSD KLVRHQRTHTGEKPYKCPECGKS FSDPGHLVRHQRTHTGEKPTGKK TS | 1105 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLTEHX_{17}X_{18}X_{19}HX_{20}X_{21}X_{22}X_{23}X_{24}X_8X_9CX_{10}X_{11}CX_{12}X_{13}X_{14}X_{15}X_{16}TTGALTEHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_{25}X_{26}X_{27}X_{28}X_{29}X_{30}$ | 2203 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gagggcggg ggcctccgg ggt | 1106 | GAG GGC GGG GGC CTT CGG GGT | LEPGEKPYKCPECGKSFSTSGHL VRHQRTHTGEKPYKCPECGKSFS RSDKLTEHQRTHTGEKPYKCPEC GKSFSTTGALTEHQRTHTGEKPY KCPECGKSFSDPGHLVRHQRTHT GEKPYKCPECGKSFSRSDKLVRH QRTHTGEKPYKCPECGKSFSDPG HLVRHQRTHTGEKPYKCPECGKS FSRSDNLVRHQRTHTGEKPTGKK TS | 1655 | $X_1X_2X_3X_4X_5X_6X_7X_8X_9CX_{10}X_{11}CX_{12}X_{13}X_{14}X_{15}X_{16}$TSGHLVRH$X_{17}X_{18}X_{19}$H$X_{20}X_{21}X_{22}X_{23}X_{24}X_8X_9$CX$_{10}X_{11}$CX$_{12}X_{13}X_{14}X_{15}X_{16}$RSDKLTEH$X_{17}X_{18}$X$_{19}$H$X_{20}X_{21}X_{22}X_{23}X_{24}X_8X_9$CX$_{10}X_{11}$CX$_{12}X_{13}X_{14}X_{15}X_{16}$TTGALTEH$X_{17}$X$_{18}X_{19}$H$X_{20}X_{21}X_{22}X_{23}X_{24}X_8X_9$CX$_{10}X_{11}$CX$_{12}X_{13}X_{14}X_{15}X_{16}$DPGHLVRH$X_{17}X_{18}X_{19}$H$X_{20}X_{21}X_{22}X_{23}X_{24}X_8X_9$CX$_{10}X_{11}$CX$_{12}X_{13}X_{14}X_{15}X_{16}$RSDKLV RH$X_{17}X_{18}X_{19}$H$X_{20}X_{21}X_{22}X_{23}X_{24}X_8X_9$CX$_{10}X_{11}$CX$_{12}X_{13}X_{14}X_{15}X_{16}$DPGH LVRH$X_{17}X_{18}X_{19}$H$X_{20}X_{21}X_{22}X_{23}X_{24}X_8X_9$CX$_{10}X_{11}$CX$_{12}X_{13}X_{14}X_{15}X_{16}$RS DNLVRH$X_{17}X_{18}X_{19}$H$X_{20}X_{21}X_{22}X_{23}X_{24}X_{25}X_{26}X_{27}X_{28}X_{29}X_{30}$ | 2204 |
| gggggcctt cgggggtggg cgc | 1107 | GGG GGC CTT CGG GGT GGG CGC | LEPGEKPYKCPECGKSFSHTGHL LEHQRTHTGEKPYKCPECGKSFS RSDKLVRHQRTHTGEKPYKCPEC GKSFSTSGHLVRHQRTHTGEKPY KCPECGKSFSRSDKLTEHQRTHT GEKPYKCPECGKSFSTTGALTEH QRTHTGEKPYKCPECGKSFSDPG HLVRHQRTHTGEKPYKCPECGKS FSRSDKLVRHQRTHTGEKPTGKK TS | 1656 | $X_1X_2X_3X_4X_5X_6X_7X_8X_9$CX$_{10}X_{11}$CX$_{12}X_{13}X_{14}X_{15}X_{16}$HTGHLLEH$X_{17}X_{18}X_{19}$H$X_{20}X_{21}X_{22}X_{23}X_{24}X_8X_9$CX$_{10}X_{11}$CX$_{12}X_{13}X_{14}X_{15}X_{16}$RSDKLVRH$X_{17}X_{18}$X$_{19}$H$X_{20}X_{21}X_{22}X_{23}X_{24}X_8X_9$CX$_{10}X_{11}$CX$_{12}X_{13}X_{14}X_{15}X_{16}$TSGHLVRH$X_{17}$X$_{18}X_{19}$H$X_{20}X_{21}X_{22}X_{23}X_{24}X_8X_9$CX$_{10}X_{11}$CX$_{12}X_{13}X_{14}X_{15}X_{16}$RSDKLTEH X$_{17}X_{18}X_{19}$H$X_{20}X_{21}X_{22}X_{23}X_{24}X_8X_9$CX$_{10}X_{11}$CX$_{12}X_{13}X_{14}X_{15}X_{16}$TTGALT EH$X_{17}X_{18}X_{19}$H$X_{20}X_{21}X_{22}X_{23}X_{24}X_8X_9$CX$_{10}X_{11}$CX$_{12}X_{13}X_{14}X_{15}X_{16}$DPGH LVRH$X_{17}X_{18}X_{19}$H$X_{20}X_{21}X_{22}X_{23}X_{24}X_8X_9$CX$_{10}X_{11}$CX$_{12}X_{13}X_{14}X_{15}X_{16}$RS DKLVRH$X_{17}X_{18}X_{19}$H$X_{20}X_{21}X_{22}X_{23}X_{24}X_{25}X_{26}X_{27}X_{28}X_{29}X_{30}$ | 2205 |
| ggagaggc agtggagg gcg | 1108 | GGA GGA GGC AGT AGG GGG GCG | LEPGEKPYKCPECGKSFSRSDDL VRHQRTHTGEKPYKCPECGKSFS RSDHLTNHQRTHTGEKPYKCPEC GKSFSRSDKLVRHQRTHTGEKPY KCPECGKSFSHRTTLTNHQRTHT GEKPYKCPECGKSFSDPGHLVRH QRTHTGEKPYKCPECGKSFSQRA HLERHQRTHTGEKPYKCPECGKS FSQRAHLERHQRTHTGEKPTGKK TS | 1657 | $X_1X_2X_3X_4X_5X_6X_7X_8X_9$CX$_{10}X_{11}$CX$_{12}X_{13}X_{14}X_{15}X_{16}$RSDDLVRH$X_{17}X_{18}X_{19}$H$X_{20}X_{21}X_{22}X_{23}X_{24}X_8X_9$CX$_{10}X_{11}$CX$_{12}X_{13}X_{14}X_{15}X_{16}$RSDHLTNH$X_{17}X_{18}$X$_{19}$H$X_{20}X_{21}X_{22}X_{23}X_{24}X_8X_9$CX$_{10}X_{11}$CX$_{12}X_{13}X_{14}X_{15}X_{16}$RSDKLVRH$X_{17}$X$_{18}X_{19}$H$X_{20}X_{21}X_{22}X_{23}X_{24}X_8X_9$CX$_{10}X_{11}$CX$_{12}X_{13}X_{14}X_{15}X_{16}$HRTTLTNH X$_{17}X_{18}X_{19}$H$X_{20}X_{21}X_{22}X_{23}X_{24}X_8X_9$CX$_{10}X_{11}$CX$_{12}X_{13}X_{14}X_{15}X_{16}$DPGHLV RH$X_{17}X_{18}X_{19}$H$X_{20}X_{21}X_{22}X_{23}X_{24}X_8X_9$CX$_{10}X_{11}$CX$_{12}X_{13}X_{14}X_{15}X_{16}$QRAH LERH$X_{17}X_{18}X_{19}$H$X_{20}X_{21}X_{22}X_{23}X_{24}X_8X_9$CX$_{10}X_{11}$CX$_{12}X_{13}X_{14}X_{15}X_{16}$QR AHLERH$X_{17}X_{18}X_{19}$H$X_{20}X_{21}X_{22}X_{23}X_{24}X_{25}X_{26}X_{27}X_{28}X_{29}X_{30}$ | 2206 |
| ggccttcgg ggtggcgc cca | 1109 | GGC CTT CGG CGG GGT GGG CGC CCA | LEPGEKPYKCPECGKSFSTSHSL TEHQRTHTGEKPYKCPECGKSFS HTGHLLEHQRTHTGEKPYKCPEC GKSFSRSDKLVRHQRTHTGEKPY KCPECGKSFSTSGHLVRHQRTHT GEKPYKCPECGKSFSRSDKLTEH QRTHTGEKPYKCPECGKSFSTTG ALTEHQRTHTGEKPYKCPECGKS FSDPGHLVRHQRTHTGEKPTGKK TS | 1658 | $X_1X_2X_3X_4X_5X_6X_7X_8X_9$CX$_{10}X_{11}$CX$_{12}X_{13}X_{14}X_{15}X_{16}$TSHSLTEH$X_{17}X_{18}X_{19}$H$X_{20}X_{21}X_{22}X_{23}X_{24}X_8X_9$CX$_{10}X_{11}$CX$_{12}X_{13}X_{14}X_{15}X_{16}$HTGHLLEH$X_{17}X_{18}$X$_{19}$H$X_{20}X_{21}X_{22}X_{23}X_{24}X_8X_9$CX$_{10}X_{11}$CX$_{12}X_{13}X_{14}X_{15}X_{16}$RSDKLVRH$X_{17}$X$_{18}X_{19}$H$X_{20}X_{21}X_{22}X_{23}X_{24}X_8X_9$CX$_{10}X_{11}$CX$_{12}X_{13}X_{14}X_{15}X_{16}$TSGHLVRH X$_{17}X_{18}X_{19}$H$X_{20}X_{21}X_{22}X_{23}X_{24}X_8X_9$CX$_{10}X_{11}$CX$_{12}X_{13}X_{14}X_{15}X_{16}$RSDKLT EH$X_{17}X_{18}X_{19}$H$X_{20}X_{21}X_{22}X_{23}X_{24}X_8X_9$CX$_{10}X_{11}$CX$_{12}X_{13}X_{14}X_{15}X_{16}$TTGA LTEH$X_{17}X_{18}X_{19}$H$X_{20}X_{21}X_{22}X_{23}X_{24}X_8X_9$CX$_{10}X_{11}$CX$_{12}X_{13}X_{14}X_{15}X_{16}$DP GHLVRH$X_{17}X_{18}X_{19}$H$X_{20}X_{21}X_{22}X_{23}X_{24}X_{25}X_{26}X_{27}X_{28}X_{29}X_{30}$ | 2207 |

TABLE 10-continued

| Column 1 Nucleotide Sequence of Target Site in HNF4α Expression Control Region | Column 2 Target sequence with space | Column 3 SEQ ID NO. (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| cttcgggt gggcgcca ggg | CTT CGG GGT CGC GCC GGG | 1110 | LEPGEKPYKCPECGKSFSRSDKL VRHQRTHTGEKPYKCPECGKSFS TSHSLTEHQRTHTGEKPYKCPEC GKSFSHTGHLLEHQRTHTGEKPY KCPECGKSFSRSDKLVRHQRTHT GEKPYKCPECGKSFSTSGHLVRH QRTHTGEKPYKCPECGKSFSRSD KLTEHQRTHTGEKPYKCPECGKS FSTTGALTEHQRTHTGEKPTGKK TS | 1659 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}HTGHLLEHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLTEHX_{17}X_{18}X_{19}HX_{20}X_{21}X_{22}X_{23}X_{24}X_8X_9CX_{10}X_{11}CX_{12}X_{13}X_{14}X_{15}X_{16}TTGALTEHX_{17}X_{18}X_{19}HX_{20}X_{21}X_{22}X_{23}X_{24}X_{25}X_{26}X_{27}X_{28}X_{29}X_{30}$ | 2208 |
| cagagaggg cactggag gag | CAG AGA GGG CAC TGG GAG GAG | 1111 | LEPGEKPYKCPECGKSFSRSDNL VRHQRTHTGEKPYKCPECGKSFS RSDNLVRHQRTHTGEKPYKCPEC GKSFSRSDHLTTHQRTHTGEKPY KCPECGKSFSSKKALTEHQRTHT GEKPYKCPECGKSFSRSDKLVRH QRTHTGEKPYKCPECGKSFSQLA HLRAHQRTHTGEKPYKCPECGKS FSRADNLTEHQRTHTGEKPTGKK TS | 1660 | $X_1X_2X_3X_4X_5X_6X_7X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QLAHLRAHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_{25}X_{26}X_{27}X_{28}X_{29}X_{30}$ | 2209 |
| agagggcac tggaggag gca | AGA GGG CAC TGG GAG GAG GCA | 1112 | LEPGEKPYKCPECGKSFSQSGDL RRHQRTHTGEKPYKCPECGKSFS RSDNLVRHQRTHTGEKPYKCPEC GKSFSRSDNLVRHQRTHTGEKPY KCPECGKSFSRSDHLTTHQRTHT GEKPYKCPECGKSFSSKKALTEH QRTHTGEKPYKCPECGKSFSRSD KLVRHQRTHTGEKPYKCPECGKS FSQLAHLRAHQRTHTGEKPTGKK TS | 1661 | $X_1X_2X_3X_4X_5X_6X_7X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTH X_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QLAHLRAHX_{17}X_{18}X_{19}HX_{20}X_{21}X_{22}X_{23}X_{24}X_{25}X_{26}X_{27}X_{28}X_{29}X_{30}$ | 2210 |
| gggcactgg gaggaggca gtg | GGG CAC TGG GAG GAG GCA GTG | 1113 | LEPGEKPYKCPECGKSFSRSDEL VRHQRTHTGEKPYKCPECGKSFS QSGDLRRHQRTHTGEKPYKCPEC GKSFSRSDNLVRHQRTHTGEKPY KCPECGKSFSRSDNLVRHQRTHT GEKPYKCPECGKSFSRSDHLTTH QRTHTGEKPYKCPECGKSFSSKK ALTEHQRTHTGEKPYKCPECGKS FSRSDKLVRHQRTHTGEKPTGKK TS | 1662 | $X_1X_2X_3X_4X_5X_6X_7X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_{25}X_{26}X_{27}X_{28}X_{29}X_{30}$ | 2211 |

TABLE 10-continued

| Column 1 Nucleotide Sequence of Target Site in HNF4α Expression Control Region | Column 3 Target sequence with space | Column 2 SEQ ID NO. (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| aggcagaga gggcactgg gag | AGG CAG AGA ggg CAC TGG GAG | 1114 | LEPGEKPYKCPECGKSFSRSDNL VRHQRTHTGEKPYKCPECGKSFS RSDHLTTHQRTHTGEKPYKCPEC GKSFSSKKALTEHQRTHTGEKPY KCPECGKSFSRSDKLVRHQRTHT GEKPYKCPECGKSFSQLAHLRAH QRTHTGEKPYKCPECGKSFSRAD NLTEHQRTHTGEKPYKCPECGKS FSRSDHLTNHQRTHTGEKPTGKK TS | 1663 | $X_1X_2X_3X_4X_5X_6X_7X_8X_9CX_{10}X_{11}CX_{12}X_{13}X_{14}X_{15}X_{16}RSDNLVRHX_{17}X_{18}X_{19}$ $HX_{20}X_{21}X_{22}X_{23}X_{24}X_8X_9CX_{10}X_{11}CX_{12}X_{13}X_{14}X_{15}X_{16}RSDHLTTHX_{17}TEHX_{17}$ $X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}$ $X_{18}X_{19}HX_{20}X_{21}X_{22}X_{23}X_{24}X_8X_9CX_{10}X_{11}CX_{12}X_{13}X_{14}X_{15}X_{16}RSDKLVRH$ $X_{17}X_{18}X_{19}HX_{20}X_{21}X_{22}X_{23}X_{24}X_8X_9CX_{10}X_{11}CX_{12}X_{13}X_{14}X_{15}X_{16}QLAHLR$ $AHX_{17}X_{18}X_{19}HX_{20}X_{21}X_{22}X_{23}X_{24}X_8X_9CX_{10}X_{11}CX_{12}X_{13}X_{14}X_{15}X_{16}RADN$ $LTEHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DHLTNHX_{17}X_{18}X_{19}HX_{20}X_{21}X_{22}X_{23}X_{24}X_{25}X_{26}X_{27}X_{28}X_{29}X_{30}$ | 2212 |
| gaggaggca gtgggaggg cgg | GAG GAG GCA GTG GGA ggg CGG | 1115 | LEPGEKPYKCPECGKSFSRSDKL TEHQRTHTGEKPYKCPECGKSFS RSDKLVRHQRTHTGEKPYKCPEC GKSFSQRAHLERHQRTHTGEKPY KCPECGKSFSRSDELVRHQRTHT GEKPYKCPECGKSFSQSGDLRRH QRTHTGEKPYKCPECGKSFSRSD NLVRHQRTHTGEKPYKCPECGKS FSRSDNLVRHQRTHTGEKPTGKK TS | 1664 | $X_1X_2X_3X_4X_5X_6X_7X_8X_9CX_{10}X_{11}CX_{12}X_{13}X_{14}X_{15}X_{16}RSDKLTEHX_{17}X_{18}X_{19}$ $HX_{20}X_{21}X_{22}X_{23}X_{24}X_8X_9CX_{10}X_{11}CX_{12}X_{13}X_{14}X_{15}X_{16}RSDKLVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}QRAHLERHX_{17}$ $X_{18}X_{19}HX_{20}X_{21}X_{22}X_{23}X_{24}X_8X_9CX_{10}X_{11}CX_{12}X_{13}X_{14}X_{15}X_{16}RSDELVRH$ $X_{17}X_{18}X_{19}HX_{20}X_{21}X_{22}X_{23}X_{24}X_8X_9CX_{10}X_{11}CX_{12}X_{13}X_{14}X_{15}X_{16}QSGDLR$ $RHX_{17}X_{18}X_{19}HX_{20}X_{21}X_{22}X_{23}X_{24}X_8X_9CX_{10}X_{11}CX_{12}X_{13}X_{14}X_{15}X_{16}RSDN$ $LVRHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DNLVRHX_{17}X_{18}X_{19}HX_{20}X_{21}X_{22}X_{23}X_{24}X_{25}X_{26}X_{27}X_{28}X_{29}X_{30}$ | 2213 |
| tggaggag gcagtggga ggg | TGG GAG GAG GCA GTG GGA GGG | 1116 | LEPGEKPYKCPECGKSFSRSDKL VRHQRTHTGEKPYKCPECGKSFS QRAHLERHQRTHTGEKPYKCPEC GKSFSRSDELVRHQRTHTGEKPY KCPECGKSFSQSGDLRRHQRTHT GEKPYKCPECGKSFSRSDNLVRH QRTHTGEKPYKCPECGKSFSRSD NLVRHQRTHTGEKPYKCPECGKS FSRSDHLTTHQRTHTGEKPTGKK TS | 1665 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}$ $HX_{20}X_{21}X_{22}X_{23}X_{24}X_8X_9CX_{10}X_{11}CX_{12}X_{13}X_{14}X_{15}X_{16}QRAHLERHX_{17}X_{18}$ $X_{19}HX_{20}X_{21}X_{22}X_{23}X_{24}X_8X_9CX_{10}X_{11}CX_{12}X_{13}X_{14}X_{15}X_{16}RSDELVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}QSGDLRRH$ $X_{17}X_{18}X_{19}HX_{20}X_{21}X_{22}X_{23}X_{24}X_8X_9CX_{10}X_{11}CX_{12}X_{13}X_{14}X_{15}X_{16}RSDNLV$ $RHX_{17}X_{18}X_{19}HX_{20}X_{21}X_{22}X_{23}X_{24}X_8X_9CX_{10}X_{11}CX_{12}X_{13}X_{14}X_{15}X_{16}RSDN$ $LVRHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DHLTTHX_{17}X_{18}X_{19}HX_{20}X_{21}X_{22}X_{23}X_{24}X_{25}X_{26}X_{27}X_{28}X_{29}X_{30}$ | 2214 |
| gaggcagtg ggagggcgg agg | GAG GCA GTG GGA ggg CGG AGG | 1117 | LEPGEKPYKCPECGKSFSRSDHL TNHQRTHTGEKPYKCPECGKSFS RSDKLTEHQRTHTGEKPYKCPEC GKSFSRSDKLVRHQRTHTGEKPY KCPECGKSFSQRAHLERHQRTHT GEKPYKCPECGKSFSDELVRHQR THTGEKPYKCPECGKSFSQSG DLRRHQRTHTGEKPYKCPECGKS FSRSDNLVRHQRTHTGEKPTGKK TS | 1666 | $X_1X_2X_3X_4X_5X_6X_7X_8X_9CX_{10}X_{11}CX_{12}X_{13}X_{14}X_{15}X_{16}RSDHLTNHX_{17}X_{18}X_{19}$ $HX_{20}X_{21}X_{22}X_{23}X_{24}X_8X_9CX_{10}X_{11}CX_{12}X_{13}X_{14}X_{15}X_{16}RSDKLTEHX_{17}X_{18}$ $X_{19}HX_{20}X_{21}X_{22}X_{23}X_{24}X_8X_9CX_{10}X_{11}CX_{12}X_{13}X_{14}X_{15}X_{16}RSDKLVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}QRAHLERH$ $X_{17}X_{18}X_{19}HX_{20}X_{21}X_{22}X_{23}X_{24}X_8X_9CX_{10}X_{11}CX_{12}X_{13}X_{14}X_{15}X_{16}RSDELV$ $RHX_{17}X_{18}X_{19}HX_{20}X_{21}X_{22}X_{23}X_{24}X_8X_9CX_{10}X_{11}CX_{12}X_{13}X_{14}X_{15}X_{16}QSGD$ $LRRHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DNLVRHX_{17}X_{18}X_{19}HX_{20}X_{21}X_{22}X_{23}X_{24}X_{25}X_{26}X_{27}X_{28}X_{29}X_{30}$ | 2215 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| cactgggag gaggcagtg gga | 1118 | CAC TGG GAG GCA GTG GGA | LEPGEKPYKCPECGKSFSQRAHL ERHQRTHTGEKPYKCPECGKSFS RSDELVRHQRTHTGEKPYKCPEC GKSFSQSGDLRRHQRTHTGEKPY KCPECGKSFSRSDNLVRHQRTHT GEKPYKCPECGKSFSRSDNLVRH QRTHTGEKPYKCPECGKSFSRSD HLTTHQRTHTGEKPYKCPECGKS FSSKKALTEHQRTHTGEKPTGKK TS | 1667 | $X_1X_2X_3X_4X_5X_6X_7X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_{25}X_{26}X_{27}X_{28}X_{29}X_{30}KALTEHX_{17}X_{18}X_{19}HX_{20}X_{21}X_{22}X_{23}X_{24}X_8X_9CX_{10}X_{11}CX_{12}X_{13}X_{14}X_{15}X_{16}SK$ | 2216 |
| aaaggaagg cagagaggg cac | 1119 | AAA GGA AGG CAG AGA GGG CAC | LEPGEKPYKCPECGKSFSSKKAL TEHQRTHTGEKPYKCPECGKSFS RSDKLVRHQRTHTGEKPYKCPEC GKSFSQLAHLRAHQRTHTGEKPY KCPECGKSFSRADNLTEHQRTHT GEKPYKCPECGKSFSRSDHLTNH QRTHTGEKPYKCPECGKSFSQRA HLERHQRTHTGEKPYKCPECGKS FSQRANLRAHQRTHTGEKPTGKK TS | 1668 | $X_1X_2X_3X_4X_5X_6X_7X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QLAHLRAHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEH X_{17}X_{18}X_{19}HX_{20}X_{21}X_{22}X_{23}X_{24}X_8X_9CX_{10}X_{11}CX_{12}X_{13}X_{14}X_{15}X_{16}RSDHLT NHX_{17}X_{18}X_{19}HX_{20}X_{21}X_{22}X_{23}X_{24}X_8X_9CX_{10}X_{11}CX_{12}X_{13}X_{14}X_{15}X_{16}QRAH LERHX_{17}X_{18}X_{19}HX_{20}X_{21}X_{22}X_{23}X_{24}X_8X_9CX_{10}X_{11}CX_{12}X_{13}X_{14}X_{15}X_{16}QR ANLRAHX_{17}X_{18}X_{19}HX_{20}X_{21}X_{22}X_{23}X_{24}X_{25}X_{26}X_{27}X_{28}X_{29}X_{30}$ | 2217 |
| ggaaggcag agaggcac tgg | 1120 | GGA AGG CAG AGA GGG CAC TGG | LEPGEKPYKCPECGKSFSRSDHL TTHQRTHTGEKPYKCPECGKSFS SKKALTEHQRTHTGEKPYKCPEC GKSFSRSDKLVRHQRTHTGEKPY KCPECGKSFSQLAHLRAHQRTHT GEKPYKCPECGKSFSRADNLTEH QRTHTGEKPYKCPECGKSFSRSD HLTNHQRTHTGEKPYKCPECGKS FSQRAHLERHQRTHTGEKPTGKK TS | 1669 | $X_1X_2X_3X_4X_5X_6X_7X_8X_9CC10X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QLAHLRAH X_{17}X_{18}X_{19}HX_{20}X_{21}X_{22}X_{23}X_{24}X_8X_9CX_{10}X_{11}CX_{12}X_{13}X_{14}X_{15}X_{16}RADNLT EHX_{17}X_{18}X_{19}HX_{20}X_{21}X_{22}X_{23}X_{24}X_8X_9CX_{10}X_{11}CX_{12}X_{13}X_{14}X_{15}X_{16}RSDH LTNHX_{17}X_{18}X_{19}HX_{20}X_{21}X_{22}X_{23}X_{24}X_8X_9CX_{10}X_{11}CX_{12}X_{13}X_{14}X_{15}X_{16}QR AHLERHX_{17}X_{18}X_{19}HX_{20}X_{21}X_{22}X_{23}X_{24}X_{25}X_{26}X_{27}X_{28}X_{29}X_{30}$ | 2218 |
| gtggaggg cggagggcg ggg | 1121 | GTG GGA GGG CGG AGG GCG GGG | LEPGEKPYKCPECGKSFSRSDKL VRHQRTHTGEKPYKCPECGKSFS RSDDLVRHQRTHTGEKPYKCPEC GKSFSRSDHLTNHQRTHTGEKPY KCPECGKSFSRSDKLTEHQRTHT GEKPYKCPECGKSFSRSDKLVRH QRTHTGEKPYKCPECGKSFSQRA HLERHQRTHTGEKPYKCPECGKS FSRSDELVRHQRTHTGEKPTGKK TS | 1670 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDDLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLTEH X_{17}X_{18}X_{19}HX_{20}X_{21}X_{22}X_{23}X_{24}X_8X_9CX_{10}X_{11}CX_{12}X_{13}X_{14}X_{15}X_{16}RSDKLV RHX_{17}X_{18}X_{19}HX_{20}X_{21}X_{22}X_{23}X_{24}X_8X_9CX_{10}X_{11}CX_{12}X_{13}X_{14}X_{15}X_{16}QRAH LERHX_{17}X_{18}X_{19}HX_{20}X_{21}X_{22}X_{23}X_{24}X_8X_9CX_{10}X_{11}CX_{12}X_{13}X_{14}X_{15}X_{16}RS DELVRHX_{17}X_{18}X_{19}HX_{20}X_{21}X_{22}X_{23}X_{24}X_{25}X_{26}X_{27}X_{28}X_{29}X_{30}$ | 2219 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gcagtggga gggcggagg gcg | 1122 | GCA GTG GGA ggg CGG AGG GCG | LEPGEKPYKCPECGKSFSRSDDL VRHQRTHTGEKPYKCPECGKSFS RSDHLTNHQRTHTGEKPYKCPEC GKSFSRSDKLTEHQRTHTGEKPY KCPECGKSFSRSDKLVRHQRTHT GEKPYKCPECGKSFSQRAHLERH QRTHTGEKPYKCPECGKSFSRSD ELVRHQRTHTGEKPYKCPECGKS FSQSGDLRRHQRTHTGEKPTGKK TS | 1671 | $X_1X_2X_3X_4X_5X_6X_7X_8X_9CX_{10}X_{11}CX_{12}X_{13}X_{14}X_{15}X_{16}RSDDLVRHX_{17}X_{18}X_{19}HX_{20}X_{21}X_{22}X_{23}X_{24}X_{8}X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_{8}X_9CX_{10}X_{11}CX_{12}X_{13}X_{14}X_{15}X_{16}RSDKLTEHX_{17}X_{18}X_{19}HX_{20}X_{21}X_{22}X_{23}X_{24}X_{8}X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_{8}X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_{8}X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_{8}X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_{25}X_{26}X_{27}X_{28}X_{29}X_{30}$ | 2220 |
| ggagggcgg agggcgggg gcc | 1123 | GGA ggg CGG AGG GCG GGG GCC | LEPGEKPYKCPECGKSFSDCRDL ARHQRTHTGEKPYKCPECGKSFS RSDKLVRHQRTHTGEKPYKCPEC GKSFSRSDDLVRHQRTHTGEKPY KCPECGKSFSRSDHLTNHQRTHT GEKPYKCPECGKSFSRSDKLTEH QRTHTGEKPYKCPECGKSFSRSD KLVRHQRTHTGEKPYKCPECGKS FSQRAHLERHQRTHTGEKPTGKK TS | 1672 | $X_1X_2X_3X_4X_5X_6X_7X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_{8}X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_{8}X_9CX_{10}X_{11}CX_{12}X_{13}X_{14}X_{15}X_{16}RSDDLVRHX_{17}X_{18}X_{19}HX_{20}X_{21}X_{22}X_{23}X_{24}X_{8}X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_{8}X_9CX_{10}X_{11}CX_{12}X_{13}X_{14}X_{15}X_{16}RSDKLTEHX_{17}X_{18}X_{19}HX_{20}X_{21}X_{22}X_{23}X_{24}X_{8}X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_{8}X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_{25}X_{26}X_{27}X_{28}X_{29}X_{30}$ | 2221 |
| cgcggcgtg gaggcaggg aga | 1124 | CGC GGC GTG GAG GCA ggg AGA | LEPGEKPYKCPECGKSFSQLAHL RAHQRTHTGEKPYKCPECGKSFS RSDKLVRHQRTHTGEKPYKCPEC GKSFSQSGDLRRHQRTHTGEKPY KCPECGKSFSRSDNLVRHQRTHT GEKPYKCPECGKSFSRSDELVRH QRTHTGEKPYKCPECGKSFSDPG HLVRHQRTHTGEKPYKCPECGKS FSHTGHLLEHQRTHTGEKPTGKK TS | 1673 | $X_1X_2X_3X_4X_5X_6X_7X_8X_9CX_{10}X_{11}CX_{12}X_{13}X_{14}X_{15}X_{16}QLAHLRAHX_{17}X_{18}X_{19}HX_{20}X_{21}X_{22}X_{23}X_{24}X_{8}X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_{8}X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_{8}X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_{8}X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_{8}X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_{8}X_9CX_{10}X_{11}CX_{12}X_{13}X_{14}X_{15}X_{16}HTGHLLEHX_{17}X_{18}X_{19}HX_{20}X_{21}X_{22}X_{23}X_{24}X_{25}X_{26}X_{27}X_{28}X_{29}X_{30}$ | 2222 |
| ggccgcggc gtggaggca ggg | 1125 | GGC CGC GGC GTG GAG GCA GGG | LEPGEKPYKCPECGKSFSRSDKL VRHQRTHTGEKPYKCPECGKSFS QSGDLRRHQRTHTGEKPYKCPEC GKSFSRSDNLVRHQRTHTGEKPY KCPECGKSFSRSDELVRHQRTHT GEKPYKCPECGKSFSDPGHLVRH QRTHTGEKPYKCPECGKSFSHTG HLLEHQRTHTGEKPYKCPECGKS FSDPGHLVRHQRTHTGEKPTGKK TS | 1674 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_{8}X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_{8}X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_{8}X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_{8}X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_{8}X_9CX_{10}X_{11}CX_{12}X_{13}X_{14}X_{15}X_{16}HTGHLLEHX_{17}X_{18}X_{19}HX_{20}X_{21}X_{22}X_{23}X_{24}X_{8}X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_{25}X_{26}X_{27}X_{28}X_{29}X_{30}$ | 2223 |

TABLE 10-continued

| Column 1 Nucleotide Sequence of Target Site in HNF4α Expression Control Region | Column 3 Target sequence with space | Column 2 SEQ ID NO. (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| ggcgtggag gcaggagaa atg | GGC GTG GAG ggg AGA ATG | 1126 | LEPGEKPYKCPECGKSFSRRDEL NVHQRTHTGEKPYKCPECGKSFS QLAHLRAHQRTHTGEKPYKCPEC GKSFSRSDKLVRHQRTHTGEKPY KCPECGKSFSQSGDLRRHQRTHT GEKPYKCPECGKSFSRSDNLVRH QRTHTGEKPYKCPECGKSFSRSD ELVRHQRTHTGEKPYKCPECGKS FSDPGHLVRHQRTHTGEKPTGKK TS | 1675 | $X_1X_2X_3X_4X_5X_6X_7X_8X_9CX_{10}X_{11}CX_{12}X_{13}X_{14}X_{15}X_{16}RRDELNVHX_{17}X_{18}X_{19}HX_{20}X_{21}X_{22}X_{23}X_{24}X_8X_9CX_{10}X_{11}CX_{12}X_{13}X_{14}X_{15}X_{16}QLAHLRAHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_{25}X_{26}X_{27}X_{28}X_{29}X_{16}DPGHLVRHX_{17}X_{18}X_{19}HX_{20}X_{21}X_{22}X_{23}X_{24}X_{25}X_{26}X_{27}X_{28}X_{29}X_{30}$ | 2224 |
| gtgaggca gggagaatg cga | GTG GAG GCA ggg AGA ATG CGA | 1127 | LEPGEKPYKCPECGKSFSQSGHL TEHQRTHTGEKPYKCPECGKSFS RRDELNVHQRTHTGEKPYKCPEC GKSFSQLAHLRAHQRTHTGEKPY KCPECGKSFSRSDKLVRHQRTHT GEKPYKCPECGKSFSQSGDLRRH QRTHTGEKPYKCPECGKSFSRSD NLVRHQRTHTGEKPYKCPECGKS FSRSDELVRHQRTHTGEKPTGKK TS | 1676 | $X_1X_2X_3X_4X_5X_6X_7X_8X_9CX_{10}X_{11}CX_{12}X_{13}X_{14}X_{15}X_{16}QSGHLTEHX_{17}X_{18}X_{19}HX_{20}X_{21}X_{22}X_{23}X_{24}X_8X_9CX_{10}X_{11}CX_{12}X_{13}X_{14}X_{15}X_{16}RRDELNVHX_{17}X_{18}X_{19}HX_{20}X_{21}X_{22}X_{23}X_{24}X_8X_9CX_{10}X_{11}CX_{12}X_{13}X_{14}X_{15}X_{16}QLAHLRAHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_{25}X_{26}X_{27}X_{28}X_{29}X_{30}$ | 2225 |
| ggggtgggc gccaggagt agg | GGG GTG GGC CAG GGT AGG | 1128 | LEPGEKPYKCPECGKSFSRSDHL TNHQRTHTGEKPYKCPECGKSFS TSGHLVRHQRTHTGEKPYKCPEC GKSFSRADNLTEHQRTHTGEKPY KCPECGKSFSDCRDLARHQRTHT GEKPYKCPECGKSFSDPGHLVRH QRTHTGEKPYKCPECGKSFSRSD ELVRHQRTHTGEKPYKCPECGKS FSRSDKLVRHQRTHTGEKPTGKK TS | 1677 | $X_1X_2X_3X_4X_5X_6X_7X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_{25}X_{26}X_{27}X_{28}X_{29}X_{16}RSDKLVRHX_{17}X_{18}X_{19}HX_{20}X_{21}X_{22}X_{23}X_{24}X_{25}X_{26}X_{27}X_{28}X_{29}X_{30}$ | 2226 |
| gtggcgcc caggtagg gca | GTG GGC GCC CAG GGT AGG GCA | 1129 | LEPGEKPYKCPECGKSFSQSGDL RRHQRTHTGEKPYKCPECGKSFS RSDHLTNHQRTHTGEKPYKCPEC GKSFSTSGHLVRHQRTHTGEKPY KCPECGKSFSRADNLTEHQRTHT GEKPYKCPECGKSFSDCRDLARH QRTHTGEKPYKCPECGKSFSDPG HLVRHQRTHTGEKPYKCPECGKS FSRSDELVRHQRTHTGEKPTGKK TS | 1678 | $X_1X_2X_3X_4X_5X_6X_7X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_{25}X_{26}X_{27}X_{28}X_{29}X_{30}$ | 2227 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gcaggtggc cgcggcgtg gag | 1130 | GCA GGT GGC CGC GGC GTG GAG | LEPGEKPYKCPECGKSFSRSDNL VRHQRTHTGEKPYKCPECGKSFS RSDELVRHQRTHTGEKPYKCPEC GKSFSDPGHLVRHQRTHTGEKPY KCPECGKSFSHTGHLLEHQRTHT GEKPYKCPECGKSFSDPGHLVRH QRTHTGEKPYKCPECGKSFSTSG HLVRHQRTHTGEKPYKCPECGKS FSQSGDLRRHQRTHTGEKPTGKK TS | 1679 | $X_1X_2X_3X_4X_5X_6X_7X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}HTGHLLEH X_{17}X_{18}X_{19}HX_{20}X_{21}X_{22}X_{23}X_{24}X_8X_9CX_{10}X_{11}CX_{12}X_{13}X_{14}X_{15}X_{16}DPGHLV RHX_{17}X_{18}X_{19}HX_{20}X_{21}X_{22}X_{23}X_{24}X_8X_9CX_{10}X_{11}CX_{12}X_{13}X_{14}X_{15}X_{16}TSGH LVRHX_{17}X_{18}X_{19}HX_{20}X_{21}X_{22}X_{23}X_{24}X_8X_9CX_{10}X_{11}CX_{12}X_{13}X_{14}X_{15}X_{16}QS GDLRRHX_{17}X_{18}X_{19}HX_{20}X_{21}X_{22}X_{23}X_{24}X_{25}X_{26}X_{27}X_{28}X_{29}X_{30}$ | 2228 |
| ggtggccgc ggctggag gca | 1131 | GGT GGC CGC GGC GTG GAG GCA | LEPGEKPYKCPECGKSFSQSGDL RRHQRTHTGEKPYKCPECGKSFS RSDNLVRHQRTHTGEKPYKCPEC GKSFSRSDELVRHQRTHTGEKPY KCPECGKSFSDPGHLVRHQRTHT GEKPYKCPECGKSFSHTGHLLEH QRTHTGEKPYKCPECGKSFSDPG HLVRHQRTHTGEKPYKCPECGKS FSTSGHLVRHQRTHTGEKPTGKK TS | 1680 | $X_1X_2X_3X_4X_5X_6X_7X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRH X_{17}X_{18}X_{19}HX_{20}X_{21}X_{22}X_{23}X_{24}X_8X_9CX_{10}X_{11}CX_{12}X_{13}X_{14}X_{15}X_{16}HTGHLL EHX_{17}X_{18}X_{19}HX_{20}X_{21}X_{22}X_{23}X_{24}X_8X_9CX_{10}X_{11}CX_{12}X_{13}X_{14}X_{15}X_{16}DPGH LVRHX_{17}X_{18}X_{19}HX_{20}X_{21}X_{22}X_{23}X_{24}X_8X_9CX_{10}X_{11}CX_{12}X_{13}X_{14}X_{15}X_{16}TS GHLVRHX_{17}X_{18}X_{19}HX_{20}X_{21}X_{22}X_{23}X_{24}X_{25}X_{26}X_{27}X_{28}X_{29}X_{30}$ | 2229 |
| agggcaggt ggccgcggc gtg | 1132 | AGG GCA GGT GGC CGC GGC GTG | LEPGEKPYKCPECGKSFSRSDEL VRHQRTHTGEKPYKCPECGKSFS DPGHLVRHQRTHTGEKPYKCPEC GKSFSHTGHLLEHQRTHTGEKPY KCPECGKSFSDPGHLVRHQRTHT GEKPYKCPECGKSFSTSGHLVRH QRTHTGEKPYKCPECGKSFSQSG DLRRHQRTHTGEKPYKCPECGKS FSRSDHLTNHQRTHTGEKPTGKK TS | 1681 | $X_1X_2X_3X_4X_5X_6X_7X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}HTGHLLEHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRH X_{17}X_{18}X_{19}HX_{20}X_{21}X_{22}X_{23}X_{24}X_8X_9CX_{10}X_{11}CX_{12}X_{13}X_{14}X_{15}X_{16}TSGHLV RHX_{17}X_{18}X_{19}HX_{20}X_{21}X_{22}X_{23}X_{24}X_8X_9CX_{10}X_{11}CX_{12}X_{13}X_{14}X_{15}X_{16}QSGD LRRHX_{17}X_{18}X_{19}HX_{20}X_{21}X_{22}X_{23}X_{24}X_8X_9CX_{10}X_{11}CX_{12}X_{13}X_{14}X_{15}X_{16}RS DHLTNHX_{17}X_{18}X_{19}HX_{20}X_{21}X_{22}X_{23}X_{24}X_{25}X_{26}X_{27}X_{28}X_{29}X_{30}$ | 2230 |
| gcccaggt agggcaggt ggc | 1133 | GCC CAG GGT AGG GCA GCA GGT GGC | LEPGEKPYKCPECGKSFSDPGHL VRHQRTHTGEKPYKCPECGKSFS TSGHLVRHQRTHTGEKPYKCPEC GKSFSQSGDLRRHQRTHTGEKPY KCPECGKSFSRSDHLTNHQRTHT GEKPYKCPECGKSFSTSGHLVRH QRTHTGEKPYKCPECGKSFSRAD NLTEHQRTHTGEKPYKCPECGKS FSDCRDLARHQRTHTGEKPTGKK TS | 1682 | $X_1X_2X_3X_4X_5X_6X_7X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNH X_{17}X_{18}X_{19}HX_{20}X_{21}X_{22}X_{23}X_{24}X_8X_9CX_{10}X_{11}CX_{12}X_{13}X_{14}X_{15}X_{16}TSGHLV RHX_{17}X_{18}X_{19}HX_{20}X_{21}X_{22}X_{23}X_{24}X_8X_9CX_{10}X_{11}CX_{12}X_{13}X_{14}X_{15}X_{16}RADN LTEHX_{17}X_{18}X_{19}HX_{20}X_{21}X_{22}X_{23}X_{24}X_8X_9CX_{10}X_{11}CX_{12}X_{13}X_{14}X_{15}X_{16}DC RDLARHX_{17}X_{18}X_{19}HX_{20}X_{21}X_{22}X_{23}X_{24}X_{25}X_{26}X_{27}X_{28}X_{29}X_{30}$ | 2231 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| ggcgcccag ggtagggca ggt | 1134 | GGC GCC CAG GCA AGG GCA GGT | LEPGEKPYKCPECGKSFSTSGHL VRHQRTHTGEKPYKCPECGKSFS QSGDLRRHQRTHTGEKPYKCPEC GKSFSRSDHLTNHQRTHTGEKPY KCPECGKSFSTSGHLVRHQRTHT GEKPYKCPECGKSFSRADNLTEH QRTHTGEKPYKCPECGKSFSDCR DLARHQRTHTGEKPYKCPECGKS FSDPGHLVRHQRTHTGEKPTGKK TS | 1683 | $X_1X_2X_3X_4X_5X_6X_7X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_{25}X_{26}X_{27}X_{28}X_{29}X_{30}$ | 2232 |
| cagggtagg gcaggtggc cgc | 1135 | CAG GGT AGG GCA GGT GGC CGC | LEPGEKPYKCPECGKSFSHTGHL LEHQRTHTGEKPYKCPECGKSFS DPGHLVRHQRTHTGEKPYKCPEC GKSFSTSGHLVRHQRTHTGEKPY KCPECGKSFSQSGDLRRHQRTHT GEKPYKCPECGKSFSRSDHLTNH QRTHTGEKPYKCPECGKSFSTSG HLVRHQRTHTGEKPYKCPECGKS FSRADNLTEHQRTHTGEKPTGKK TS | 1684 | $X_1X_2X_3X_4X_5X_6X_7X_8X_9CX_{10}X_{11}CX_{12}X_{13}X_{14}X_{15}X_{16}HTGHLLEHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_{25}X_{26}X_{27}X_{28}X_{29}X_{30}$ | 2233 |
| ggtagggca ggtggccgc ggc | 1136 | GGT AGG GCA GGT GGC CGC GGC | LEPGEKPYKCPECGKSFSDPGHL VRHQRTHTGEKPYKCPECGKSFS HTGHLLEHQRTHTGEKPYKCPEC GKSFSDPGHLVRHQRTHTGEKPY KCPECGKSFSTSGHLVRHQRTHT GEKPYKCPECGKSFSQSGDLRRH QRTHTGEKPYKCPECGKSFSRSD HLTNHQRTHTGEKPYKCPECGKS FSTSGHLVRHQRTHTGEKPTGKK TS | 1685 | $X_1X_2X_3X_4X_5X_6X_7X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}HTGHLLEHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHVLTNHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_{25}X_{26}X_{27}X_{28}X_{29}X_{30}$ | 2234 |
| agggtaggg caggtggcc gcg | 1137 | AGG GTA ggg CAG GTG GCC GCG | LEPGEKPYKCPECGKSFSRSDDL VRHQRTHTGEKPYKCPECGKSFS DCRDLARHQRTHTGEKPYKCPEC GKSFSRSDELVRHQRTHTGEKPY KCPECGKSFSRADNLTEHQRTHT GEKPYKCPECGKSFSRSDKLVRH QRTHTGEKPYKCPECGKSFSQSS SLVRHQRTHTGEKPYKCPECGKS FSRSDHLTNHQRTHTGEKPTGKK TS | 1686 | $X_1X_2X_3X_4X_5X_6X_7X_8X_9CX_{10}X_{11}CX_{12}X_{13}X_{14}X_{15}X_{16}RSDDLVRHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSSSLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_{25}X_{26}X_{27}X_{28}X_{29}X_{30}$ | 2235 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| cccgggta gggcaggtg gcc | 1138 | CCC AGG GTA ggg CAG GTG GCC | LEPGEKPYKCPECGKSFSDCRDL ARHQRTHTGEKPYKCPECGKSFS RSDELVRHQRTHTGEKPYKCPEC GKSFSRADNLTEHQRTHTGEKPY KCPECGKSFSRSDKLVRHQRTHT GEKPYKCPECGKSFSQSSLVRH QRTHTGEKPYKCPECGKSFSRSD HLTNHQRTHTGEKPYKCPECGKS FSSKKHLAEHQRTHTGEKPTGKK TS | 1687 | $X_1X_2X_3X_4X_5X_6X_7X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRH X_{17}X_{18}X_{19}HX_{20}X_{21}X_{22}X_{23}X_{24}X_8X_9CX_{10}X_{11}CX_{12}X_{13}X_{14}X_{15}X_{16}QSSSLV RHX_{17}X_{18}X_{19}HX_{20}X_{21}X_{22}X_{23}X_{24}X_8X_9CX_{10}X_{11}CX_{12}X_{13}X_{14}X_{15}X_{16}RSDH LTNHX_{17}X_{18}X_{19}HX_{20}X_{21}X_{22}X_{23}X_{24}X_8X_9CX_{10}X_{11}CX_{12}X_{13}X_{14}X_{15}X_{16}SK KHLAEHX_{17}X_{18}X_{19}HX_{20}X_{21}X_{22}X_{23}X_{24}X_{25}X_{26}X_{27}X_{28}X_{29}X_{30}$ | 2236 |
| gtaggcag gtggccgcg gcg | 1139 | GTA ggg CAG GTG GCC GCG GCG | LEPGEKPYKCPECGKSFSRSDDL VRHQRTHTGEKPYKCPECGKSFS RSDDLVRHQRTHTGEKPYKCPEC GKSFSDCRDLARHQRTHTGEKPY KCPECGKSFSRSDELVRHQRTHT GEKPYKCPECGKSFSRADNLTEH QRTHTGEKPYKCPECGKSFSRSD KLVRHQRTHTGEKPYKCPECGKS FSQSSLVRHQRTHTGEKPTGKK TS | 1688 | $X_1X_2X_3X_4X_5X_6X_7X_8X_9CX_{10}X_{11}CX_{12}X_{13}X_{14}X_{15}X_{16}RSDDLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDDLVRHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRH X_{17}X_{18}X_{19}HX_{20}X_{21}X_{22}X_{23}X_{24}X_8X_9CX_{10}X_{11}CX_{12}X_{13}X_{14}X_{15}X_{16}RADNLT EHX_{17}X_{18}X_{19}HX_{20}X_{21}X_{22}X_{23}X_{24}X_8X_9CX_{10}X_{11}CX_{12}X_{13}X_{14}X_{15}X_{16}RSDK LVRHX_{17}X_{18}X_{19}HX_{20}X_{21}X_{22}X_{23}X_{24}X_8X_9CX_{10}X_{11}CX_{12}X_{13}X_{14}X_{15}X_{16}QS SSLVRHX_{17}X_{18}X_{19}HX_{20}X_{21}X_{22}X_{23}X_{24}X_{25}X_{26}X_{27}X_{28}X_{29}X_{30}$ | 2237 |
| gggcaggtg gccgccggcg tgg | 1140 | ggg CAG GTG GCC GCG GCG TGG | LEPGEKPYKCPECGKSFSRSDHL TTHQRTHTGEKPYKCPECGKSFS RSDDLVRHQRTHTGEKPYKCPEC GKSFSRSDDLVRHQRTHTGEKPY KCPECGKSFSDCRDLARHQRTHT GEKPYKCPECGKSFSRSDELVRH QRTHTGEKPYKCPECGKSFSRAD NLTEHQRTHTGEKPYKCPECGKS FSRSDKLVRHQRTHTGEKPTGKK TS | 1689 | $X_1X_2X_3X_4X_5X_6X_7X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}RSDDLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDDLVRHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARH X_{17}X_{18}X_{19}HX_{20}X_{21}X_{22}X_{23}X_{24}X_8X_9CX_{10}X_{11}CX_{12}X_{13}X_{14}X_{15}X_{16}RSDELV RHX_{17}X_{18}X_{19}HX_{20}X_{21}X_{22}X_{23}X_{24}X_8X_9CX_{10}X_{11}CX_{12}X_{13}X_{14}X_{15}X_{16}RADN LTEHX_{17}X_{18}X_{19}HX_{20}X_{21}X_{22}X_{23}X_{24}X_8X_9CX_{10}X_{11}CX_{12}X_{13}X_{14}X_{15}X_{16}RS DKLVRHX_{17}X_{18}X_{19}HX_{20}X_{21}X_{22}X_{23}X_{24}X_{25}X_{26}X_{27}X_{28}X_{29}X_{30}$ | 2238 |
| gtggccgcg gcgtggagg cag | 1141 | GTG GCC GCG GCG TGG AGG CAG | LEPGEKPYKCPECGKSFSRADNL TEHQRTHTGEKPYKCPECGKSFS RSDHLTNHQRTHTGEKPYKCPEC GKSFSRSDHLTTHQRTHTGEKPY KCPECGKSFSRSDDLVRHQRTHT GEKPYKCPECGKSFSRSDDLVRH QRTHTGEKPYKCPECGKSFSDCR DLARHQRTHTGEKPYKCPECGKS FSRSDELVRHQRTHTGEKPTGKK TS | 1690 | $X_1X_2X_3X_4X_5X_6X_7X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}RSDDLV RHX_{17}X_{18}X_{19}HX_{20}X_{21}X_{22}X_{23}X_{24}X_8X_9CX_{10}X_{11}CX_{12}X_{13}X_{14}X_{15}X_{16}RSDDLV LARHX_{17}X_{18}X_{19}HX_{20}X_{21}X_{22}X_{23}X_{24}X_8X_9CX_{10}X_{11}CX_{12}X_{13}X_{14}X_{15}X_{16}DCRD DELVRHX_{17}X_{18}X_{19}HX_{20}X_{21}X_{22}X_{23}X_{24}X_{25}X_{26}X_{27}X_{28}X_{29}X_{30}$ | 2239 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| caggtggcc gcggctgg agg | 1142 | CAG GTG GCC GCG TGG AGG | LEPGEKPYKCPECGKSFSRSDHL TNHQRTHTGEKPYKCPECGKSFS RSDHLTTHQRTHTGEKPYKCPEC GKSFSRSDDLVRHQRTHTGEKPY KCPECGKSFSRSDDLVRHQRTHT GEKPYKCPECGKSFSDCRDLARH QRTHTGEKPYKCPECGKSFSRSD ELVRHQRTHTGEKPYKCPECGKS FSRADNLTEHQRTHTGEKPTGKK TS | 1691 | $X_1X_2X_3X_4X_5X_6X_7X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}RSDDLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDDLVRHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_{25}X_{26}X_{27}X_{28}X_{29}X_{30}$ | 2240 |
| gcgcccagg gtaggcag gtg | 1143 | gcg CCC AGG GTA GCA CAG GTG | LEPGEKPYKCPECGKSFSRSDEL VRHQRTHTGEKPYKCPECGKSFS RADNLTEHQRTHTGEKPYKCPEC GKSFSRSDKLVRHQRTHTGEKPY KCPECGKSFSQSSLVRHQRTHT GEKPYKCPECGKSFSRSDHLTNH QRTHTGEKPYKCPECGKSFSSKK HLAEHQRTHTGEKPYKCPECGKS FSRSDDLVRHQRTHTGEKPTGKK TS | 1692 | $X_1X_2X_3X_4X_5X_6X_7X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSSSLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}RSDDLVRHX_{17}X_{18}X_{19}HX_{20}X_{21}X_{22}X_{23}X_{24}X_{25}X_{26}X_{27}X_{28}X_{29}X_{30}$ | 2241 |
| gggtgggcg cccagggta ggg | 1144 | GGG TGG gcg ccg CCC AGG GTA GGG | LEPGEKPYKCPECGKSFSRSDKL VRHQRTHTGEKPYKCPECGKSFS QSSSLVRHQRTHTGEKPYKCPEC GKSFSRSDHLTNHQRTHTGEKPY KCPECGKSFSSKKHLAEHQRTHT GEKPYKCPECGKSFSRSDDLVRH QRTHTGEKPYKCPECGKSFSRSD HLTTHQRTHTGEKPYKCPECGKS FSRSDKLVRHQRTHTGEKPTGKK TS | 1693 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSSSLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}RSDDLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_{25}X_{26}X_{27}X_{28}X_{29}X_{30}$ | 2242 |
| tgggggcc agggtaggg cag | 1145 | TGG gcg CCC AGG GTA AGG CAG ggg | LEPGEKPYKCPECGKSFSRADNL TEHQRTHTGEKPYKCPECGKSFS RSDKLVRHQRTHTGEKPYKCPEC GKSFSQSSSLVRHQRTHTGEKPY KCPECGKSFSRSDHLTNHQRTHT GEKPYKCPECGKSFSSKKHLAEH QRTHTGEKPYKCPECGKSFSRSD DLVRHQRTHTGEKPYKCPECGKS FSRSDHLTTHQRTHTGEKPTGKK TS | 1694 | $X_1X_2X_3X_4X_5X_6X_7X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSSSLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}RSDDLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_{25}X_{26}X_{27}X_{28}X_{29}X_{30}$ | 2243 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gcggcgtgg aggcaggga gaa | 1146 | GCG GCG TGG AGG CAG GGA GAA | LEPGEKPYKCPECGKSFSQSSNL VRHQRTHTGEKPYKCPECGKSFS QRAHLERHQRTHTGEKPYKCPEC GKSFSRADNLTEHQRTHTGEKPY KCPECGKSFSRSDHLTNHQRTHT GEKPYKCPECGKSFSRSDHLTTH QRTHTGEKPYKCPECGKSFSRSD DLVRHQRTHTGEKPYKCPECGKS FSRSDDLVRHQRTHTGEKPTGKK TS | 1695 | $X_1X_2X_3X_4X_5X_6X_7X_8X_9CX_{10}X_{11}CX_{12}X_{13}X_{14}X_{15}X_{16}QSSNLVRHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNH X_{17}X_{18}X_{19}HX_{20}X_{21}X_{22}X_{23}X_{24}X_8X_9CX_{10}X_{11}CX_{12}X_{13}X_{14}X_{15}X_{16}RSDHLT THX_{17}X_{18}X_{19}HX_{20}X_{21}X_{22}X_{23}X_{24}X_8X_9CX_{10}X_{11}CX_{12}X_{13}X_{14}X_{15}X_{16}RSDD LVRHX_{17}X_{18}X_{19}HX_{20}X_{21}X_{22}X_{23}X_{24}X_8X_9CX_{10}X_{11}CX_{12}X_{13}X_{14}X_{15}X_{16}RS DDLVRHX_{17}X_{18}X_{19}HX_{20}X_{21}X_{22}X_{23}X_{24}X_{25}X_{26}X_7X_{28}X_{29}X_{30}$ | 2244 |
| gccgcggcg tggaggcag gga | 1147 | GCC GCG GCG TGG AGG CAG GGA | LEPGEKPYKCPECGKSFSQRAHL ERHQRTHTGEKPYKCPECGKSFS RADNLTEHQRTHTGEKPYKCPEC GKSFSRSDHLTNHQRTHTGEKPY KCPECGKSFSRSDHLTTHQRTHT GEKPYKCPECGKSFSRSDDLVRH QRTHTGEKPYKCPECGKSFSRSD DLVRHQRTHTGEKPYKCPECGKS FSDCRDLARHQRTHTGEKPTGKK TS | 1696 | $X_1X_2X_3X_4X_5X_6X_7X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTH X_{17}X_{18}X_{19}HX_{20}X_{21}X_{22}X_{23}X_{24}X_8X_9CX_{10}X_{11}CX_{12}X_{13}X_{14}X_{15}X_{16}RSDDLV RHX_{17}X_{18}X_{19}HX_{20}X_{21}X_{22}X_{23}X_{24}X_8X_9CX_{10}X_{11}CX_{12}X_{13}X_{14}X_{15}X_{16}RSDD LVRHX_{17}X_{18}X_{19}HX_{20}X_{21}X_{22}X_{23}X_{24}X_8X_9CX_{10}X_{11}CX_{12}X_{13}X_{14}X_{15}X_{16}DC RDLARHX_{17}X_{18}X_{19}HX_{20}X_{21}X_{22}X_{23}X_{24}X_{25}X_{26}X_{27}X_{28}X_{29}X_{30}$ | 2245 |
| aaccctcgt cgacatgga cat | 1148 | AAC CCT CGT CGA CAT GGA CAT | LEPGEKPYKCPECGKSFSTSGNL TEHQRTHTGEKPYKCPECGKSFS QRAHLERHQRTHTGEKPYKCPEC GKSFSTSGNLTEHQRTHTGEKPY KCPECGKSFSQSGHLTEHQRTHT GEKPYKCPECGKSFSSRRTCRAH QRTHTGEKPYKCPECGKSFSTKN SLTEHQRTHTGEKPYKCPECGKS FSDSGNLRVHQRTHTGEKPTGKK TS | 1697 | $X_1X_2X_3X_4X_5X_6X_7X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}QSGHLTEH X_{17}X_{18}X_{19}HX_{20}X_{21}X_{22}X_{23}X_{24}X_8X_9CX_{10}X_{11}CX_{12}X_{13}X_{14}X_{15}X_{16}SRRTCR AHX_{17}X_{18}X_{19}HX_{20}X_{21}X_{22}X_{23}X_{24}X_8X_9CX_{10}X_{11}CX_{12}X_{13}X_{14}X_{15}X_{16}TKNS LTEHX_{17}X_{18}X_{19}HX_{20}X_{21}X_{22}X_{23}X_{24}X_8X_9CX_{10}X_{11}CX_{12}X_{13}X_{14}X_{15}X_{16}DS GNLRVHX_{17}X_{18}X_{19}HX_{20}X_{21}X_{22}X_{23}X_{24}X_{25}X_{26}X_{27}X_{28}X_{29}X_{30}$ | 2246 |
| cctcgtcga catgacat ggc | 1149 | CCT CGT CGA CAT GGA CAT GGC | LEPGEKPYKCPECGKSFSDPGHL VRHQRTHTGEKPYKCPECGKSFS TSGNLTEHQRTHTGEKPYKCPEC GKSFSQRAHLERHQRTHTGEKPY KCPECGKSFSTSGNLTEHQRTHT GEKPYKCPECGKSFSQSGHLTEH QRTHTGEKPYKCPECGKSFSSRR TCRAHQRTHTGEKPYKCPECGKS FSTKNSLTEHQRTHTGEKPTGKK TS | 1698 | $X_1X_2X_3X_4X_5X_6X_7X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}QSGHLT EHX_{17}X_{18}X_{19}HX_{20}X_{21}X_{22}X_{23}X_{24}X_8X_9CX_{10}X_{11}CX_{12}X_{13}X_{14}X_{15}X_{16}SRRT CRAHX_{17}X_{18}X_{19}HX_{20}X_{21}X_{22}X_{23}X_{24}X_8X_9CX_{10}X_{11}CX_{12}X_{13}X_{14}X_{15}X_{16}TK NSLTEHX_{17}X_{18}X_{19}HX_{20}X_{21}X_{22}X_{23}X_{24}X_{25}X_{26}X_{27}X_{28}X_{29}X_{30}$ | 2247 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| catgacat ggccgacta cag | 1150 | CAT GGA CAT GGC CGA CTA CAG | LEPGEKPYKCPECGKSFSRADNL TEHQRTHTGEKPYKCPECGKSFS QNSTLTEHQRTHTGEKPYKCPEC GKSFSQSGHLTEHQRTHTGEKPY KCPECGKSFSDPGHLVRHQRTHT GEKPYKCPECGKSFSTSGNLTEH QRTHTGEKPYKCPECGKSFSQRA HLERHQRTHTGEKPYKCPECGKS FSTSGNLTEHQRTHTGEKPTGKK TS | 1699 | $X_1X_2X_3X_4X_5X_6X_7X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_{8}X_{9}CX_{10}X_{11}CX_{12}X_{13}X_{14}X_{15}X_{16}QNSTLTEHX_{17}X_{18}X_{19}HX_{20}X_{21}X_{22}X_{23}X_{24}X_{8}X_{9}CX_{10}X_{11}CX_{12}X_{13}X_{14}X_{15}X_{16}QSGHLTEHX_{17}X_{18}X_{19}HX_{20}X_{21}X_{22}X_{23}X_{24}X_{8}X_{9}CX_{10}X_{11}CX_{12}X_{13}X_{14}X_{15}X_{16}DPGHLVRHX_{17}X_{18}X_{19}HX_{20}X_{21}X_{22}X_{23}X_{24}X_{8}X_{9}CX_{10}X_{11}CX_{12}X_{13}X_{14}X_{15}X_{16}TSGNLTEHX_{17}X_{18}X_{19}HX_{20}X_{21}X_{22}X_{23}X_{24}X_{8}X_{9}CX_{10}X_{11}CX_{12}X_{13}X_{14}X_{15}X_{16}QRAHLERHX_{17}X_{18}X_{19}HX_{20}X_{21}X_{22}X_{23}X_{24}X_{25}X_{26}X_{27}X_{28}X_{29}X_{30}$ | 2248 |
| caaaaccct cgtcgacat gga | 1151 | CAA AAC CCT CGT CGA CAT GGA | LEPGEKPYKCPECGKSFSQRAHL ERHQRTHTGEKPYKCPECGKSFS TSGNLTEHQRTHTGEKPYKCPEC GKSFSQSGHLTEHQRTHTGEKPY KCPECGKSFSSRRTCRAHQRTHT GEKPYKCPECGKSFSTKNSLTEH QRTHTGEKPYKCPECGKSFSDSG NLRVHQRTHTGEKPYKCPECGKS FSQSGNLTEHQRTHTGEKPTGKK TS | 1700 | $X_1X_2X_3X_4X_5X_6X_7X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_{8}X_{9}CX_{10}X_{11}CX_{12}X_{13}X_{14}X_{15}X_{16}TSGNLTEHX_{17}X_{18}X_{19}HX_{20}X_{21}X_{22}X_{23}X_{24}X_{8}X_{9}CX_{10}X_{11}CX_{12}X_{13}X_{14}X_{15}X_{16}QSGHLTEHX_{17}X_{18}X_{19}HX_{20}X_{21}X_{22}X_{23}X_{24}X_{8}X_{9}CX_{10}X_{11}CX_{12}X_{13}X_{14}X_{15}X_{16}SRRTCRAHX_{17}X_{18}X_{19}HX_{20}X_{21}X_{22}X_{23}X_{24}X_{8}X_{9}CX_{10}X_{11}CX_{12}X_{13}X_{14}X_{15}X_{16}TKNSLTEHX_{17}X_{18}X_{19}HX_{20}X_{21}X_{22}X_{23}X_{24}X_{8}X_{9}CX_{10}X_{11}CX_{12}X_{13}X_{14}X_{15}X_{16}DSGNLRVHX_{17}X_{18}X_{19}HX_{20}X_{21}X_{22}X_{23}X_{24}X_{8}X_{9}CX_{10}X_{11}CX_{12}X_{13}X_{14}X_{15}X_{16}QSGNLTEHX_{17}X_{18}X_{19}HX_{20}X_{21}X_{22}X_{23}X_{24}X_{25}X_{26}X_{27}X_{28}X_{29}X_{30}$ | 2249 |
| cgtcgacat ggacatggc cga | 1152 | CGT CGA CAT GGA CAT GGC CGA | LEPGEKPYKCPECGKSFSQSGHL TEHQRTHTGEKPYKCPECGKSFS DPGHLVRHQRTHTGEKPYKCPEC GKSFSTSGNLTEHQRTHTGEKPY KCPECGKSFSQRAHLERHQRTHT GEKPYKCPECGKSFSTSGNLTEH QRTHTGEKPYKCPECGKSFSQSG HLTEHQRTHTGEKPYKCPECGKS FSSRRTCRAHQRTHTGEKPTGKK TS | 1701 | $X_1X_2X_3X_4X_5X_6X_8X_9CX_{10}X_{11}CX_{12}X_{13}X_{14}X_{15}X_{16}QSGHLTEHX_{17}X_{18}X_{19}HX_{20}X_{21}X_{22}X_{23}X_{24}X_{8}X_{9}CX_{10}X_{11}CX_{12}X_{13}X_{14}X_{15}X_{16}DPGHLVRHX_{17}X_{18}X_{19}HX_{20}X_{21}X_{22}X_{23}X_{24}X_{8}X_{9}CX_{10}X_{11}CX_{12}X_{13}X_{14}X_{15}X_{16}TSGNLTEHX_{17}X_{18}X_{19}HX_{20}X_{21}X_{22}X_{23}X_{24}X_{8}X_{9}CX_{10}X_{11}CX_{12}X_{13}X_{14}X_{15}X_{16}QRAHLERHX_{17}X_{18}X_{19}HX_{20}X_{21}X_{22}X_{23}X_{24}X_{8}X_{9}CX_{10}X_{11}CX_{12}X_{13}X_{14}X_{15}X_{16}TSGNLTEHX_{17}X_{18}X_{19}HX_{20}X_{21}X_{22}X_{23}X_{24}X_{8}X_{9}CX_{10}X_{11}CX_{12}X_{13}X_{14}X_{15}X_{16}QSGHLTEHX_{17}X_{18}X_{19}HX_{20}X_{21}X_{22}X_{23}X_{24}X_{8}X_{9}CX_{10}X_{11}CX_{12}X_{13}X_{14}X_{15}X_{16}SRRTCRAHX_{17}X_{18}X_{19}HX_{20}X_{21}X_{22}X_{23}X_{24}X_{25}X_{26}X_{27}X_{28}X_{29}X_{30}$ | 2250 |
| cgacatgga catggccga cta | 1153 | CGA CAT GGA CAT GGC CGA CTA | LEPGEKPYKCPECGKSFSQNSTL TEHQRTHTGEKPYKCPECGKSFS QSGHLTEHQRTHTGEKPYKCPEC GKSFSDPGHLVRHQRTHTGEKPY KCPECGKSFSTSGNLTEHQRTHT GEKPYKCPECGKSFSQRAHLERH QRTHTGEKPYKCPECGKSFSTSG NLTEHQRTHTGEKPYKCPECGKS FSQSGHLTEHQRTHTGEKPTGKK TS | 1702 | $XX_2X_3X_4X_5X_6X_7X_8X_9CX_{10}X_{11}CX_{12}X_{13}X_{14}X_{15}X_{16}QNSTLTEHX_{17}X_{18}X_{19}HX_{20}X_{21}X_{22}X_{23}X_{24}X_{8}X_{9}CX_{10}X_{11}CX_{12}X_{13}X_{14}X_{15}X_{16}QSGHLTEHX_{17}X_{18}X_{19}HX_{20}X_{21}X_{22}X_{23}X_{24}X_{8}X_{9}CX_{10}X_{11}CX_{12}X_{13}X_{14}X_{15}X_{16}DPGHLVRHX_{17}X_{18}X_{19}HX_{20}X_{21}X_{22}X_{23}X_{24}X_{8}X_{9}CX_{10}X_{11}CX_{12}X_{13}X_{14}X_{15}X_{16}TSGNLTEHX_{17}X_{18}X_{19}HX_{20}X_{21}X_{22}X_{23}X_{24}X_{8}X_{9}CX_{10}X_{11}CX_{12}X_{13}X_{14}X_{15}X_{16}QRAHLERHX_{17}X_{18}X_{19}HX_{20}X_{21}X_{22}X_{23}X_{24}X_{8}X_{9}CX_{10}X_{11}CX_{12}X_{13}X_{14}X_{15}X_{16}TSGNLTEHX_{17}X_{18}KX_{19}HX_{20}X_{21}X_{22}X_{23}X_{24}X_{8}X_{9}CX_{10}X_{11}CX_{12}X_{13}X_{14}X_{15}X_{16}QSGHLTEHX_{17}X_{18}X_{19}HX_{20}X_{21}X_{22}X_{23}X_{24}X_{25}X_{26}X_{27}X_{28}X_{29}X_{30}$ | 2251 |

TABLE 10-continued

| Column 1 Nucleotide Sequence of Target Site in HNF4α Expression Control Region | Column 2 Target sequence with space | Column 3 Target sequence | Column 4 Amino acid Sequence of Zinc Finger DNA Binding Domain Polypeptides Targeting the Target Site in Column 1 | Column 5 SEQ ID NO. (corresponds to sequences in Columns 1 and 3) | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gtcgacatggacatggcgac | GTC GAC ATG GAC ATG GCC GAC | LEPGEKPYKCPECGKSFSDPGNLVRHQRTHTGEKPYKCPECGKSFSDCRDLARHQRTHTGEKPYKCPECGKSFSRRDELNVHQRTHTGEKPYKCPECGKSFSDPGNLVRHQRTHTGEKPYKCPECGKSFSRRDELNVHQRTHTGEKPYKCPECGKSFSDPGNLVRHQRTHTGEKPYKCPECGKSFSDPGALVRHQRTHTGEKPTGKKTS | 1154 | $X_1X_2X_3X_4X_5X_6X_7X_8X_9CX_{10}X_{11}CX_{12}X_{13}X_{14}X_{15}X_{16}$DPGNLVRH$X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$DCRDLARH$X_{17}X_{18}$ $X_{19}$H$X_{20}X_{21}X_{22}X_{23}X_{24}X_8X_9$C$X_{10}X_{11}$C$X_{12}X_{13}X_{14}X_{15}X_{16}$RRDELNVH$X_{17}$ $X_{18}X_{19}$H$X_{20}X_{21}X_{22}X_{23}X_{24}X_8X_9$C$X_{10}X_{11}$C$X_{12}X_{13}X_{14}X_{15}X_{16}$DPGNLVRH $X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$RRDELN VH$X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$DPGN LVRH$X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$DP GALVRH$X_{17}X_{18}X_{19}$H$X_{20}X_{21}X_{22}X_{23}X_{24}X_{25}X_{26}X_{27}X_{28}X_{29}X_{30}$ | 2252 |
| gtgctgcactggaccccagcct | gtg CTG CAC TGG ACC CAG CCT | LEPGEKPYKCPECGKSFSTKNSLTEHQRTHTGEKPYKCPECGKSFSRADNLTEHQRTHTGEKPYKCPECGKSFSDKKDLTRHQRTHTGEKPYKCPECGKSFSRSDHLTTHQRTHTGEKPYKCPECGKSFSSKKALTEHQRTHTGEKPYKCPECGKSFSRNDALTEHQRTHTGEKPYKCPECGKSFSRSDELVRHQRTHTGEKPTGKKTS | 1155 | $X_1X_2X_3X_4X_5X_6X_7X_8X_9$C$X_{10}X_{11}$C$X_{12}X_{13}X_{14}X_{15}X_{16}$TKNSLTEH$X_{17}X_{18}X_{19}$ H$X_{20}X_{21}X_{22}X_{23}X_{24}X_8X_9$C$X_{10}X_{11}$C$X_{12}X_{13}X_{14}X_{15}X_{16}$RADNLTEH$X_{17}X_{18}$ $X_{19}$H$X_{20}X_{21}X_{22}X_{23}X_{24}X_8X_9$C$X_{10}X_{11}$C$X_{12}X_{13}X_{14}X_{15}X_{16}$DKKDLTRH$X_{17}$ $X_{18}X_{19}$H$X_{20}X_{21}X_{22}X_{23}X_{24}X_8X_9$C$X_{10}X_{11}$C$X_{12}X_{13}X_{14}X_{15}X_{16}$RSDHLTTH $X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$SKKALT EH$X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$RNDA LTEH$X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$RS DELVRH$X_{17}X_{18}X_{19}$H$X_{20}X_{21}X_{22}X_{23}X_{24}X_{25}X_{26}X_{27}X_{28}X_{29}X_{30}$ | 2253 |
| acagtgctgcactggacccag | ACA gtg CTG CAC TGG ACC CAG | LEPGEKPYKCPECGKSFSRADNLTEHQRTHTGEKPYKCPECGKSFSDKKDLTRHQRTHTGEKPYKCPECGKSFSRSDHLTTHQRTHTGEKPYKCPECGKSFSSKKALTEHQRTHTGEKPYKCPECGKSFSRNDALTEHQRTHTGEKPYKCPECGKSFSRSDELVRHQRTHTGEKPYKCPECGKSFSSPADLTRHQRTHTGEKPTGKKTS | 1156 | $X_1X_2X_3X_4X_5X_6X_7X_8X_9$C$X_{10}X_{11}$C$X_{12}X_{13}X_{14}X_{15}X_{16}$RADNLTEH$X_{17}X_{18}X_{19}$ H$X_{20}X_{21}X_{22}X_{23}X_{24}X_8X_9$C$X_{10}X_{11}$C$X_{12}X_{13}X_{14}X_{15}X_{16}$DKKDLTRH$X_{17}X_{18}$ $X_{19}$H$X_{20}X_{21}X_{22}X_{23}X_{24}X_8X_9$C$X_{10}X_{11}$C$X_{12}X_{13}X_{14}X_{15}X_{16}$RSDHLTTH$X_{17}$ $X_{18}X_{19}$H$X_{20}X_{21}X_{22}X_{23}X_{24}X_8X_9$C$X_{10}X_{11}$C$X_{12}X_{13}X_{14}X_{15}X_{16}$SKKALTEH $X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$RNDALT EH$X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$RSDE LVRH$X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$SP ADLTRH$X_{17}X_{18}X_{19}$H$X_{20}X_{21}X_{22}X_{23}X_{24}X_{25}X_{26}X_{27}X_{28}X_{29}X_{30}$ | 2254 |
| ctgcactggaccagcctaca | CTG CAC TGG ACC CAG CCT ACA | LEPGEKPYKCPECGKSFSSPADLTRHQRTHTGEKPYKCPECGKSFSTKNSLTEHQRTHTGEKPYKCPECGKSFSRADNLTEHQRTHTGEKPYKCPECGKSFSDKKDLTRHQRTHTGEKPYKCPECGKSFSRSDHLTTHQRTHTGEKPYKCPECGKSFSSKKALTEHQRTHTGEKPYKCPECGKSFSRNDALTEHQRTHTGEKPTGKKTS | 1157 | $X_1X_2X_3X_4X_5X_6X_7X_8X_9$C$X_{10}X_{11}$C$X_{12}X_{13}X_{14}X_{15}X_{16}$SPADLTRH$X_{17}X_{18}X_{19}$ H$X_{20}X_{21}X_{22}X_{23}X_{24}X_8X_9$C$X_{10}X_{11}$C$X_{12}X_{13}X_{14}X_{15}X_{16}$TKNSLTEH$X_{17}X_{18}$ $X_{19}$H$X_{20}X_{21}X_{22}X_{23}X_{24}X_8X_9$C$X_{10}X_{11}$C$X_{12}X_{13}X_{14}X_{15}X_{16}$RADNLTEH$X_{17}$ $X_{18}X_{19}$H$X_{20}X_{21}X_{22}X_{23}X_{24}X_8X_9$C$X_{10}X_{11}$C$X_{12}X_{13}X_{14}X_{15}X_{16}$DKKDLTRH $X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$RSDHLT TH$X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$SKKA LTEH$X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$RN DALTEH$X_{17}X_{18}X_{19}$H$X_{20}X_{21}X_{22}X_{23}X_{24}X_{25}X_{26}X_{27}X_{28}X_{29}X_{30}$ | 2255 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| cactggacc cagcctaca cca | 1158 | CAC TGG ACC CAG CCT ACA CCA | LEPGEKPYKCPECGKSFSTSHSL TEHQRTHTGEKPYKCPECGKSFS SPADLTRHQRTHTGEKPYKCPEC GKSFSTKNSLTEHQRTHTGEKPY KCPECGKSFSRADNLTEHQRTHT GEKPYKCPECGKSFSDKKDLTRH QRTHTGEKPYKCPECGKSFSRSD HLTTHQRTHTGEKPYKCPECGKS FSSKKALTEHQRTHTGEKPTGKK TS | 1707 | $X_1X_2X_3X_4X_5X_6X_7X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEH X_{17}X_{18}X_{19}HX_{20}X_{21}X_{22}X_{23}X_{24}X_8X_9CX_{10}X_{11}CX_{12}X_{13}X_{14}X_{15}X_{16}DKKDLT RHX_{17}X_{18}X_{19}HX_{20}X_{21}X_{22}X_{23}X_{24}X_8X_9CX_{10}X_{11}CX_{12}X_{13}X_{14}X_{15}X_{16}RSDH LTTHX_{17}X_{18}X_{19}HX_{20}X_{21}X_{22}X_{23}X_{24}X_8X_9CX_{10}X_{11}CX_{12}X_{13}X_{14}X_{15}X_{16}SK KALTEHX_{17}X_{18}X_{19}HX_{20}X_{21}X_{22}X_{23}X_{24}X_{25}X_{26}X_{27}X_{28}X_{29}X_{30}$ | 2256 |
| actacagtg ctgactggg acc | 1159 | ACT ACA gtg CTG CAC TGG ACC | LEPGEKPYKCPECGKSFSDKKDL TRHQRTHTGEKPYKCPECGKSFS RSDHLTTHQRTHTGEKPYKCPEC GKSFSSKKALTEHQRTHTGEKPY KCPECGKSFSRNDALTEHQRTHT GEKPYKCPECGKSFSRSDELVRH QRTHTGEKPYKCPECGKSFSSPA DLTRHQRTHTGEKPYKCPECGKS FSTHLDLIRHQRTHTGEKPTGKK TS | 1708 | $X_1X_2X_3X_4X_5X_6X_7X_8X_9CX_{10}X_{11}CX_{12}X_{13}X_{14}X_{15}X_{16}DKKDLTRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEH X_{17}X_{18}X_{19}HX_{20}X_{21}X_{22}X_{23}X_{24}X_8X_9CX_{10}X_{11}CX_{12}X_{13}X_{14}X_{15}X_{16}RSDELV RHX_{17}X_{18}X_{19}HX_{20}X_{21}X_{22}X_{23}X_{24}X_8X_9CX_{10}X_{11}CX_{12}X_{13}X_{14}X_{15}X_{16}SPAD LTRHX_{17}X_{18}X_{19}HX_{20}X_{21}X_{22}X_{23}X_{24}X_8X_9CX_{10}X_{11}CX_{12}X_{13}X_{14}X_{15}X_{16}TH LDLIRHX_{17}X_{18}X_{19}HX_{20}X_{21}X_{22}X_{23}X_{24}X_{25}X_{26}X_{27}X_{28}X_{29}X_{30}$ | 2257 |
| acatggccg actacagtg ctg | 1160 | ACA TGG CCG ACT ACA gtg CTG | LEPGEKPYKCPECGKSFSRNDAL TEHQRTHTGEKPYKCPECGKSFS RSDELVRHQRTHTGEKPYKCPEC GKSFSSPADLTRHQRTHTGEKPY KCPECGKSFSTHLDLIRHQRTHT GEKPYKCPECGKSFSRNDTLTEH QRTHTGEKPYKCPECGKSFSRSD HLTTHQRTHTGEKPYKCPECGKS FSSPADLTRHQRTHTGEKPTGKK TS | 1709 | $X_1X_2X_3X_4X_5X_6X_7X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}THLDLIRH X_{17}X_{18}X_{19}HX_{20}X_{21}X_{22}X_{23}X_{24}X_8X_9CX_{10}X_{11}CX_{12}X_{13}X_{14}X_{15}X_{16}RNDTLT EHX_{17}X_{18}X_{19}HX_{20}X_{21}X_{22}X_{23}X_{24}X_8X_9CX_{10}X_{11}CX_{12}X_{13}X_{14}X_{15}X_{16}RSDH LTTHX_{17}X_{18}X_{19}HX_{20}X_{21}X_{22}X_{23}X_{24}X_8X_9CX_{10}X_{11}CX_{12}X_{13}X_{14}X_{15}X_{16}SP ADLTRHX_{17}X_{18}X_{19}HX_{20}X_{21}X_{22}X_{23}X_{24}X_{25}X_{26}X_{27}X_{28}X_{29}X_{30}$ | 2258 |
| tggacatgg ccgactaca gtg | 1161 | TGG ACA TGG CCG ACT ACA GTG | LEPGEKPYKCPECGKSFSRSDEL VRHQRTHTGEKPYKCPECGKSFS SPADLTRHQRTHTGEKPYKCPEC GKSFSTHLDLIRHQRTHTGEKPY KCPECGKSFSRNDTLTEHQRTHT GEKPYKCPECGKSFSSDHLTTH QRTHTGEKPYKCPECGKSFSSPA DLTRHQRTHTGEKPYKCPECGKS FSRSDHLTTHQRTHTGEKPTGKK TS | 1710 | $X_1X_2X_3X_4X_5X_6X_7X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}THLDLIRHX_{17}X_{18}X_{19}HX_{20}X_{21}X_{22}X_{23}X_{24}X_8X_9CX_{10}X_{11}CX_{12}X_{13}X_{14}X_{15}X_{16}RNDTLTEH X_{17}X_{18}X_{19}HX_{20}X_{21}X_{22}X_{23}X_{24}X_8X_9CX_{10}X_{11}CX_{12}X_{13}X_{14}X_{15}X_{16}SPAD THX_{17}X_{18}X_{19}HX_{20}X_{21}X_{22}X_{23}X_{24}X_8X_9CX_{10}X_{11}CX_{12}X_{13}X_{14}X_{15}X_{16}SPAD LTRHX_{17}X_{18}X_{19}HX_{20}X_{21}X_{22}X_{23}X_{24}X_8X_9CX_{10}X_{11}CX_{12}X_{13}X_{14}X_{15}X_{16}RS DHLTTHX_{17}X_{18}X_{19}HX_{20}X_{21}X_{22}X_{23}X_{24}X_{25}X_{26}X_{27}X_{28}X_{29}X_{30}$ | 2259 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| cagcctaca ccaccctgg aat | 1162 | CAG CCT ACA CCA CCC TGG AAT | LEPGEKPYKCPECGKSFSTTGNL TTHQRTHTGEKPYKCPECGKSFS RSDHLTTHQRTHTGEKPYKCPEC GKSFSSKKHLAEHQRTHTGEKPY KCPECGKSFSTSHSLTEHQRTHT GEKPYKCPECGKSFSSPADLTRH QRTHTGEKPYKCPECGKSFSTKN SLTEHQRTHTGEKPYKCPECGKS FSRADNLTEHQRTHTGEKPTGKK TS | 1711 | $X_1X_2X_3X_4X_5X_6X_7X_8X_9CX_{10}X_{11}CX_{12}X_{13}X_{14}X_{15}X_{16}TTGNLTVHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_{25}X_{26}X_{27}X_{28}X_{29}X_{30}$ | 2260 |
| acatggaca tggccgact aca | 1163 | ACA TGG ACA TGG CCG ACT ACA | LEPGEKPYKCPECGKSFSSPADL TRHQRTHTGEKPYKCPECGKSFS THLDLIRHQRTHTGEKPYKCPEC GKSFSRNDTLTEHQRTHTGEKPY KCPECGKSFSRSDHLTTHQRTHT GEKPYKCPECGKSFSSPADLTRH QRTHTGEKPYKCPECGKSFSRSD HLTTHQRTHTGEKPYKCPECGKS FSSPADLTRHQRTHTGEKPTGKK TS | 1712 | $X_1X_2X_3X_4X_5X_6X_7X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}THLDLIRHX_{17}X_{18}X_{19}HX_{20}X_{21}X_{22}X_{23}X_{24}X_8X_9CX_{10}X_{11}CX_{12}X_{13}X_{14}X_{15}X_{16}RNDTLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_{25}X_{26}X_{27}X_{28}X_{29}X_{30}$ | 2261 |
| tggacccag cctacacca ccc | 1164 | TGG ACC CAG CCT ACA CCA CCC | LEPGEKPYKCPECGKSFSSKKHL AEHQRTHTGEKPYKCPECGKSFS TSHSLTEHQRTHTGEKPYKCPEC GKSFSSPADLTRHQRTHTGEKPY KCPECGKSFSTKNSLTEHQRTHT GEKPYKCPECGKSFSRADNLTEH QRTHTGEKPYKCPECGKSFSDKK DLTRHQRTHTGEKPYKCPECGKS FSRSDHLTTHQRTHTGEKPTGKK TS | 1713 | $X_1X_2X_3X_4X_5X_6X_7X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}DKKDLTRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_{25}X_{26}X_{27}X_{28}X_{29}X_{30}$ | 2262 |
| acccagcct acaccaccc tgg | 1165 | ACC CAG CCT ACA CCA CCC TGG | LEPGEKPYKCPECGKSFSRSDHL TTHQRTHTGEKPYKCPECGKSFS SKKHLAEHQRTHTGEKPYKCPEC GKSFSTSHSLTEHQRTHTGEKPY KCPECGKSFSSPADLTRHQRTHT GEKPYKCPECGKSFSTKNSLTEH QRTHTGEKPYKCPECGKSFSRAD NLTEHQRTHTGEKPYKCPECGKS FSDKKDLTRHQRTHTGEKPTGKK TS | 1714 | $X_1X_2X_3X_4X_5X_6X_7X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}DKKDLTRHX_{17}X_{18}X_{19}HX_{20}X_{21}X_{22}X_{23}X_{24}X_{25}X_{26}X_{27}X_{28}X_{29}X_{30}$ | 2263 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| ccgactaca gtgctgcac tgg | 1166 | CCG ACT ACA gtg CTG CAC TGG | LEPGEKPYKCPECGKSFSRSDHL TTHQRTHTGEKPYKCPECGKSFS SKKALTEHQRTHTGEKPYKCPEC GKSFSRNDALTEHQRTHTGEKPY KCPECGKSFSRSDELVRHQRTHT GEKPYKCPECGKSFSSPADLTRH QRTHTGEKPYKCPECGKSFSTHL DLIRHQRTHTGEKPYKCPECGKS FSRNDTLTEHQRTHTGEKPTGKK TS | 1715 | $X_1X_2X_3X_4X_5X_6X_7X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}THLDLIRHX_{17}X_{18}X_{19}HX_{20}X_{21}X_{22}X_{23}X_{24}X_8X_9CX_{10}X_{11}CX_{12}X_{13}X_{14}X_{15}X_{16}RNDTLTEHX_{17}X_{18}X_{19}HX_{20}X_{21}X_{22}X_{23}X_{24}X_{25}X_{26}X_{27}X_{28}X_{29}X_{30}$ | 2264 |
| tggccgact acagtgctg cac | 1167 | TGG CCG ACT ACA gtg CTG CAC | LEPGEKPYKCPECGKSFSSKKAL TEHQRTHTGEKPYKCPECGKSFS RNDALTEHQRTHTGEKPYKCPEC GKSFSRSDELVRHQRTHTGEKPY KCPECGKSFSSPADLTRHQRTHT GEKPYKCPECGKSFSTHLDLIRH QRTHTGEKPYKCPECGKSFSRND TLTEHQRTHTGEKPYKCPECGKS FSRSDHLTTHQRTHTGEKPTGKK TS | 1716 | $X_1X_2X_3X_4X_5X_6X_7X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}THLDLIRHX_{17}X_{18}X_{19}HX_{20}X_{21}X_{22}X_{23}X_{24}X_8X_9CX_{10}X_{11}CX_{12}X_{13}X_{14}X_{15}X_{16}RNDTLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_{25}X_{26}X_{27}X_{28}X_{29}X_{30}$ | 2265 |
| agtgctgca ctggaccca gcc | 1168 | AGT GCT GCA CTG GAC CCA GCC | LEPGEKPYKCPECGKSFSDCRDL ARHQRTHTGEKPYKCPECGKSFS TSHSLTEHQRTHTGEKPYKCPEC GKSFSDPGNLVRHQRTHTGEKPY KCPECGKSFSRNDALTEHQRTHT GEKPYKCPECGKSFSQSGDLRRH QRTHTGEKPYKCPECGKSFSTSG ELVRHQRTHTGEKPYKCPECGKS FSHRTTLTNHQRTHTGEKPTGKK TS | 1717 | $X_1X_2X_3X_4X_5X_6X_7X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}DPGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}TSGELVRHX_{17}X_{18}X_{19}HX_{20}X_{21}X_{22}X_{23}X_{24}X_8X_9CX_{10}X_{11}CX_{12}X_{13}X_{14}X_{15}X_{16}HRTTLTNHX_{17}X_{18}X_{19}HX_{20}X_{21}X_{22}X_{23}X_{24}X_{25}X_{26}X_{27}X_{28}X_{29}X_{30}$ | 2266 |
| ctacaccac cctggaatt tga | 1169 | CTA CAC CAC CCT GGA ATT TGA | LEPGEKPYKCPECGKSFSQAGHL ASHQRTHTGEKPYKCPECGKSFS HKNALQNHQRTHTGEKPYKCPEC GKSFSQRAHLERHQRTHTGEKPY KCPECGKSFSTKNSLTEHQRTHT GEKPYKCPECGKSFSSKKALTEH QRTHTGEKPYKCPECGKSFSSKK ALTEHQRTHTGEKPYKCPECGKS FSQNSTLTEHQRTHTGEKPTGKK TS | 1718 | $X_1X_2X_3X_4X_5X_6X_7X_8X_9CX_{10}X_{11}CX_{12}X_{13}X_{14}X_{15}X_{16}QAGHLASHX_{17}X_{18}X_{19}HX_{20}X_{21}X_{22}X_{23}X_{24}X_8X_9CX_{10}X_{11}CX_{12}X_{13}X_{14}X_{15}X_{16}HKNALQNHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}QNSTLTEHX_{17}X_{18}X_{19}HX_{20}X_{21}X_{22}X_{23}X_{24}X_{25}X_{26}X_{27}X_{28}X_{29}X_{30}$ | 2267 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| agcctacac cacctgga att | 1170 | AGC CTA CAC CCT GGA ATT | LEPGEKPYKCPECGKSFSHKNAL QNHQRTHTGEKPYKCPECGKSFS QRAHLERHQRTHTGEKPYKCPEC GKSFSTKNSLTEHQRTHTGEKPY KCPECGKSFSSKKALTEHQRTHT GEKPYKCPECGKSFSSKKALTEH QRTHTGEKPYKCPECGKSFSQNS TLTEHQRTHTGEKPYKCPECGKS FSERSHLREHQRTHTGEKPTGKK TS | 1719 | $X_1X_2X_3X_4X_5X_6X_7X_8X_9CX_{10}X_{11}CX_{12}X_{13}X_{14}X_{15}X_{16}HKNALQNHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEH X_{17}X_{18}X_{19}HX_{20}X_{21}X_{22}X_{23}X_{24}X_8X_9CX_{10}X_{11}CX_{12}X_{13}X_{14}X_{15}X_{16}SKKALT EHX_{17}X_{18}X_{19}HX_{20}X_{21}X_{22}X_{23}X_{24}X_8X_9CX_{10}X_{11}CX_{12}X_{13}X_{14}X_{15}X_{16}QNST LTEHX_{17}X_{18}X_{19}HX_{20}X_{21}X_{22}X_{23}X_{24}X_8X_9CX_{10}X_{11}CX_{12}X_{13}X_{14}X_{15}X_{16}ER SHLREHX_{17}X_{18}X_{19}HX_{20}X_{21}X_{22}X_{23}X_{24}X_{25}X_{26}X_{27}X_{28}X_{29}X_{30}$ | 2268 |
| caccaccct ggaattga gaa | 1171 | CAC CCT GGA ATT TGA GAA | LEPGEKPYKCPECGKSFSQSSNL VRHQRTHTGEKPYKCPECGKSFS QAGHLASHQRTHTGEKPYKCPEC GKSFSHKNALQNHQRTHTGEKPY KCPECGKSFSQRAHLERHQRTHT GEKPYKCPECGKSFSTKNSLTEH QRTHTGEKPYKCPECGKSFSSKK ALTEHQRTHTGEKPYKCPECGKS FSSKKALTEHQRTHTGEKPTGKK TS | 1720 | $X_1X_2X_3X_4X_5X_6X_7X_8X_9CX_{10}X_{11}CX_{12}X_{13}X_{14}X_{15}X_{16}QSSNLVRHX_{17}X_{18}X_{19}HX_{20}X_{21}X_{22}X_{23}X_{24}X_8X_9CX_{10}X_{11}CX_{12}X_{13}X_{14}X_{15}X_{16}QAGHLASHX_{17}X_{18}X_{19}HX_{20}X_{21}X_{22}X_{23}X_{24}X_8X_9CX_{10}X_{11}CX_{12}X_{13}X_{14}X_{15}X_{16}HKNALQNHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERH X_{17}X_{18}X_{19}HX_{20}X_{21}X_{22}X_{23}X_{24}X_8X_9CX_{10}X_{11}CX_{12}X_{13}X_{14}X_{15}X_{16}TKNSLT EHX_{17}X_{18}X_{19}HX_{20}X_{21}X_{22}X_{23}X_{24}X_8X_9CX_{10}X_{11}CX_{12}X_{13}X_{14}X_{15}X_{16}SKKA LTEHX_{17}X_{18}X_{19}HX_{20}X_{21}X_{22}X_{23}X_{24}X_{25}X_{26}X_{27}X_{28}X_{29}X_{30}$ | 2269 |
| ggaccagc ctacaccac cct | 1172 | GGA CCC AGC CTA CAC CAC CCT | LEPGEKPYKCPECGKSFSTKNSL TEHQRTHTGEKPYKCPECGKSFS SKKALTEHQRTHTGEKPYKCPEC GKSFSSKKALTEHQRTHTGEKPY KCPECGKSFSQNSTLTEHQRTHT GEKPYKCPECGKSFSERSHLREH QRTHTGEKPYKCPECGKSFSSKK HLAEHQRTHTGEKPYKCPECGKS FSQRAHLERHQRTHTGEKPTGKK TS | 1721 | $X_1X_2X_3X_4X_5X_6X_7X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}QNSTLTEH X_{17}X_{18}X_{19}HX_{20}X_{21}X_{22}X_{23}X_{24}X_8X_9CX_{10}X_{11}CX_{12}X_{13}X_{14}X_{15}X_{16}ERSHLR EHX_{17}X_{18}X_{19}HX_{20}X_{21}X_{22}X_{23}X_{24}X_8X_9CX_{10}X_{11}CX_{12}X_{13}X_{14}X_{15}X_{16}SKKH LAEHX_{17}X_{18}X_{19}HX_{20}X_{21}X_{22}X_{23}X_{24}X_8X_9CX_{10}X_{11}CX_{12}X_{13}X_{14}X_{15}X_{16}QR AHLERHX_{17}X_{18}X_{19}HX_{20}X_{21}X_{22}X_{23}X_{24}X_{25}X_{26}X_{27}X_{28}X_{29}X_{30}$ | 2270 |
| cccagccta caccccct gga | 1173 | CCC AGC CTA CAC CAC CCT GGA | LEPGEKPYKCPECGKSFSQRAHL ERHQRTHTGEKPYKCPECGKSFS TKNSLTEHQRTHTGEKPYKCPEC GKSFSSKKALTEHQRTHTGEKPY KCPECGKSFSSKKALTEHQRTHT GEKPYKCPECGKSFSQNSTLTEH QRTHTGEKPYKCPECGKSFSERS HLREHQRTHTGEKPYKCPECGKS FSSKKHLAEHQRTHTGEKPTGKK TS | 1722 | $X_1X_2X_3X_4X_5X_6X_7X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEH X_{17}X_{18}X_{19}HX_{20}X_{21}X_{22}X_{23}X_{24}X_8X_9CX_{10}X_{11}CX_{12}X_{13}X_{14}X_{15}X_{16}QNSTLT EHX_{17}X_{18}X_{19}HX_{20}X_{21}X_{22}X_{23}X_{24}X_8X_9CX_{10}X_{11}CX_{12}X_{13}X_{14}X_{15}X_{16}ERSH LREHX_{17}X_{18}X_{19}HX_{20}X_{21}X_{22}X_{23}X_{24}X_8X_9CX_{10}X_{11}CX_{12}X_{13}X_{14}X_{15}X_{16}SK KHLAEHX_{17}X_{18}X_{19}HX_{20}X_{21}X_{22}X_{23}X_{24}X_{25}X_{26}X_{27}X_{28}X_{29}X_{30}$ | 2271 |

TABLE 10-continued

| Column 1 Nucleotide Sequence of Target Site in HNF4α Expression Control Region | Column 2 Target sequence with space | Column 3 Target sequence | Column 4 Amino acid Sequence of Zinc Finger DNA Binding Domain Polypeptides Targeting the Target Site in Column 1 | Column 5 SEQ ID NO. (corresponds to sequences in Columns 1 and 3) | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| actgaccc agcctacac cac | ACT GGA CCC AGC CTA CAC CAC | | LEPGEKPYKCPECGKSFSKKAL TEHQRTHTGEKPYKCPECGKSFS SKKALTEHQRTHTGEKPYKCPEC GKSFSQNSTLTEHQRTHTGEKPY KCPECGKSFSERSHLREHQRTHT GEKPYKCPECGKSFSSKKHLAEH QRTHTGEKPYKCPECGKSFSQRA HLERHQRTHTGEKPYKCPECGKS FSTHLDLIRHQRTHTGEKPTGKK TS | 1174 | $X_1X_2X_3X_4X_5X_6X_7X_8X_9CX_{10}X_{11}CX_{12}X_{13}X_{14}X_{15}X_{16}$SKKALTEH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$SKKALTEH$X_{17}X_{18}$ $X_{19}$H$X_{20}X_{21}X_{22}X_{23}X_{24}X_8X_9CX_{10}X_{11}CX_{12}X_{13}X_{14}X_{15}X_{16}$QNSTLTEH$X_{17}$ $X_{18}X_{19}$H$X_{20}X_{21}X_{22}X_{23}X_{24}X_8X_9CX_{10}X_{11}CX_{12}X_{13}X_{14}X_{15}X_{16}$ERSHLREH $X_{17}X_{18}X_{19}$H$X_{20}X_{21}X_{22}X_{23}X_{24}X_8X_9CX_{10}X_{11}CX_{12}X_{13}X_{14}X_{15}X_{16}$SKKHLA EH$X_{17}X_{18}X_{19}$H$X_{20}X_{21}X_{22}X_{23}X_{24}X_8X_9CX_{10}X_{11}CX_{12}X_{13}X_{14}X_{15}X_{16}$QRAH LERH$X_{17}X_{18}X_{19}$H$X_{20}X_{21}X_{22}X_{23}X_{24}X_8X_9CX_{10}X_{11}CX_{12}X_{13}X_{14}X_{15}X_{16}$TH LDLIRH$X_{17}X_{18}X_{19}$H$X_{20}X_{21}X_{22}X_{23}X_{24}X_{25}X_{26}X_{27}X_{28}X_{29}X_{30}$ | 2272 |
| tggtaggtg gggcagat gtg | TGG TAG GTG GGG GCA GAT GTG | | LEPGEKPYKCPECGKSFSRSDEL VRHQRTHTGEKPYKCPECGKSFS TSGNLVRHQRTHTGEKPYKCPEC GKSFSQSGDLRRHQRTHTGEKPY KCPECGKSFSRSDKLVRHQRTHT GEKPYKCPECGKSFSRSDELVRH QRTHTGEKPYKCPECGKSFSRED NLHTHQRTHTGEKPYKCPECGKS FSRSDHLTTHQRTHTGEKPTGKK TS | 1175 | $X_1X_2X_3X_4X_5X_6X_7X_8X_9CX_{10}X_{11}CX_{12}X_{13}X_{14}X_{15}X_{16}$RSDELVRH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$TSGNLVRH$X_{17}X_{18}$ $X_{19}$H$X_{20}X_{21}X_{22}X_{23}X_{24}X_8X_9CX_{10}X_{11}CX_{12}X_{13}X_{14}X_{15}X_{16}$QSGDLRRH$X_{17}$ $X_{18}X_{19}$H$X_{20}X_{21}X_{22}X_{23}X_{24}X_8X_9CX_{10}X_{11}CX_{12}X_{13}X_{14}X_{15}X_{16}$RSDKLVRH $X_{17}X_{18}X_{19}$H$X_{20}X_{21}X_{22}X_{23}X_{24}X_8X_9CX_{10}X_{11}CX_{12}X_{13}X_{14}X_{15}X_{16}$RSDELV RH$X_{17}X_{18}X_{19}$H$X_{20}X_{21}X_{22}X_{23}X_{24}X_8X_9CX_{10}X_{11}CX_{12}X_{13}X_{14}X_{15}X_{16}$REDN LHTH$X_{17}X_{18}X_{19}$H$X_{20}X_{21}X_{22}X_{23}X_{24}X_8X_9CX_{10}X_{11}CX_{12}X_{13}X_{14}X_{15}X_{16}$RS DHLTTH$X_{17}X_{18}X_{19}$H$X_{20}X_{21}X_{22}X_{23}X_{24}X_{25}X_{26}X_{27}X_{28}X_{29}X_{30}$ | 2273 |
| taggtgggg gcagatgtg ccc | TAG GTG GGG GCA GAT gtg CCC | | LEPGEKPYKCPECGKSFSSKKHL AEHQRTHTGEKPYKCPECGKSFS RSDELVRHQRTHTGEKPYKCPEC GKSFSTSGNLVRHQRTHTGEKPY KCPECGKSFSQSGDLRRHQRTHT GEKPYKCPECGKSFSRSDKLVRH QRTHTGEKPYKCPECGKSFSRSD ELVRHQRTHTGEKPYKCPECGKS FSREDNLHTHQRTHTGEKPTGKK TS | 1176 | $X_1X_2X_3X_4X_5X_6X_7X_8X_9CX_{10}X_{11}CX_{12}X_{13}X_{14}X_{15}X_{16}$SKKHLAEH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$RSDELVRH$X_{17}X_{18}$ $X_{19}$H$X_{20}X_{21}X_{22}X_{23}X_{24}X_8X_9CX_{10}X_{11}CX_{12}X_{13}X_{14}X_{15}X_{16}$TSGNLVRH$X_{17}$ $X_{18}X_{19}$H$X_{20}X_{21}X_{22}X_{23}X_{24}X_8X_9CX_{10}X_{11}CX_{12}X_{13}X_{14}X_{15}X_{16}$QSGDLRRH $X_{17}X_{18}X_{19}$H$X_{20}X_{21}X_{22}X_{23}X_{24}X_8X_9CX_{10}X_{11}CX_{12}X_{13}X_{14}X_{15}X_{16}$RSDKLV RH$X_{17}X_{18}X_{19}$H$X_{20}X_{21}X_{22}X_{23}X_{24}X_8X_9CX_{10}X_{11}CX_{12}X_{13}X_{14}X_{15}X_{16}$RSDE LVRH$X_{17}X_{18}X_{19}$H$X_{20}X_{21}X_{22}X_{23}X_{24}X_8X_9CX_{10}X_{11}CX_{12}X_{13}X_{14}X_{15}X_{16}$RE DNLHTH$X_{17}X_{18}X_{19}$H$X_{20}X_{21}X_{22}X_{23}X_{24}X_{25}X_{26}X_{27}X_{28}X_{29}X_{30}$ | 2274 |
| gatgggcaa tggtaggtg ggg | GAT ggg CAA TGG TAG GTG GGG | | LEPGEKPYKCPECGKSFSRSDKL VRHQRTHTGEKPYKCPECGKSFS RSDELVRHQRTHTGEKPYKCPEC GKSFSREDNLHTHQRTHTGEKPY KCPECGKSFSRSDHLTTHQRTHT GEKPYKCPECGKSFSQSGNLTEH QRTHTGEKPYKCPECGKSFSRSD KLVRHQRTHTGEKPYKCPECGKS FSTSGNLVRHQRTHTGEKPTGKK TS | 1177 | $X_1X_2X_3X_4X_5X_6X_7X_8X_9CX_{10}X_{11}CX_{12}X_{13}X_{14}X_{15}X_{16}$RSDKLVRH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$RSDELVRH$X_{17}X_{18}$ $X_{19}$H$X_{20}X_{21}X_{22}X_{23}X_{24}X_8X_9CX_{10}X_{11}CX_{12}X_{13}X_{14}X_{15}X_{16}$REDNLHTH$X_{17}$ $X_{18}X_{19}$H$X_{20}X_{21}X_{22}X_{23}X_{24}X_8X_9CX_{10}X_{11}CX_{12}X_{13}X_{14}X_{15}X_{16}$RSDHLTTH $X_{17}X_{18}X_{19}$H$X_{20}X_{21}X_{22}X_{23}X_{24}X_8X_9CX_{10}X_{11}CX_{12}X_{13}X_{14}X_{15}X_{16}$QSGNLT EH$X_{17}X_{18}X_{19}$H$X_{20}X_{21}X_{22}X_{23}X_{24}X_8X_9CX_{10}X_{11}CX_{12}X_{13}X_{14}X_{15}X_{16}$RSDK LVRH$X_{17}X_{18}X_{19}$H$X_{20}X_{21}X_{22}X_{23}X_{24}X_8X_9CX_{10}X_{11}CX_{12}X_{13}X_{14}X_{15}X_{16}$TS GNLVRH$X_{17}X_{18}X_{19}$H$X_{20}X_{21}X_{22}X_{23}X_{24}X_{25}X_{26}X_{27}X_{28}X_{29}X_{30}$ | 2275 |

TABLE 10-continued

| Column 1 Nucleotide Sequence of Target Site in HNF4α Expression Control Region | Column 2 Target sequence with space | Column 3 Target sequence | Column 4 SEQ ID NO. (corresponds to sequences in Columns 1 and 3) | Column 5 Amino acid Sequence of Zinc Finger DNA Binding Domain Polypeptides Targeting the Target Site in Column 1 | Column 6 SEQ ID NO: | Column 7 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|---|
| gggcaatgg taggtgggg gca | ggg CAA TGG TAG GTG GGG GCA | | 1178 | LEPGEKPYKCPECGKSFSQSGDL RRHQRTHTGEKPYKCPECGKSFS RSDKLVRHQRTHTGEKPYKCPEC GKSFSRSDELVRHQRTHTGEKPY KCPECGKSFSREDNLHTHQRTHT GEKPYKCPECGKSFSRSDKLTTH QRTHTGEKPYKCPECGKSFSQSG NLTEHQRTHTGEKPYKCPECGKS FSRSDKLVRHQRTHTGEKPTGKK TS | 1727 | $X_1X_2X_3X_4X_5X_6X_7X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}REDNLHTHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}QSGNLTEHX_{17}X_{18}X_{19}HX_{20}X_{21}X_{22}X_{23}X_{24}X_{25}X_{26}X_{27}X_{28}X_{29}X_{30}RSDKLVRHX_{17}X_{18}X_{19}HX_{20}X_{21}X_{22}X_{23}X_{24}X_{25}X_{26}X_{27}X_{28}X_{29}X_{30}$ | 2276 |
| caatggtag gtggggca gat | CAA TGG TAG GTG GGG GCA GAT | | 1179 | LEPGEKPYKCPECGKSFSTSGNL VRHQRTHTGEKPYKCPECGKSFS QSGDLRRHQRTHTGEKPYKCPEC GKSFSRSDKLVRHQRTHTGEKPY KCPECGKSFSRSDELVRHQRTHT GEKPYKCPECGKSFSREDNLHTH QRTHTGEKPYKCPECGKSFSRSD HLTTHQRTHTGEKPYKCPECGKS FSQSGNLTEHQRTHTGEKPTGKK TS | 1728 | $X_1X_2X_3X_4X_5X_6X_7X_8X_9CX_{10}X_{11}CX_{12}X_{13}X_{14}X_{15}X_{16}TSGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}REDNLHTHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}QSGNLTEHX_{17}X_{18}X_{19}HX_{20}X_{21}X_{22}X_{23}X_{24}X_{25}X_{26}X_{27}X_{28}X_{29}X_{30}$ | 2277 |
| gtggggca gatgtgccc agg | GTG GGG GCA GAT gtg CCC AGG | | 1180 | LEPGEKPYKCPECGKSFSRSDHL TNHQRTHTGEKPYKCPECGKSFS SKKHLAEHQRTHTGEKPYKCPEC GKSFSRSDELVRHQRTHTGEKPY KCPECGKSFSTSGNLVRHQRTHT GEKPYKCPECGKSFSQSGDLRRH QRTHTGEKPYKCPECGKSFSRSD KLVRHQRTHTGEKPYKCPECGKS FSRSDELVRHQRTHTGEKPTGKK TS | 1729 | $X_1X_2X_3X_4X_5X_6X_7X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_{25}X_{26}X_{27}X_{28}X_{29}X_{30}$ | 2278 |
| gacgatggg caatggtag gtg | GAC GAT ggg CAA TGG TAG GTG | | 1181 | LEPGEKPYKCPECGKSFSRSDEL VRHQRTHTGEKPYKCPECGKSFS REDNLHTHQRTHTGEKPYKCPEC GKSFSRSDHLTTHQRTHTGEKPY KCPECGKSFSQSGNLTEHQRTHT GEKPYKCPECGKSFSRSDKLVRH QRTHTGEKPYKCPECGKSFSTSG NLVRHQRTHTGEKPYKCPECGKS FSDPGNLVRHQRTHTGEKPTGKK TS | 1730 | $X_1X_2X_3X_4X_5X_6X_7X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}REDNLHTHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}QSGNLTEH X_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLVRHX_{17}X_{18}X_{19}HX_{20}X_{21}X_{22}X_{23}X_{24}X_{25}X_{26}X_{27}X_{28}X_{29}X_{30}DPGNLVRHX_{17}X_{18}X_{19}HX_{20}X_{21}X_{22}X_{23}X_{24}X_{25}X_{26}X_{27}X_{28}X_{29}X_{30}$ | 2279 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gttgacgat gggcaatgg tag | 1182 | GTT GAC GAT ggg CAA TGG TAG | LEPGEKPYKCPECGKSFSREDNL HTHQRTHTGEKPYKCPECGKSFS RSDHLTTHQRTHTGEKPYKCPEC GKSFSQSGNLTEHQRTHTGEKPY KCPECGKSFSRSDKLVRHQRTHT GEKPYKCPECGKSFSTSGNLVRH QRTHTGEKPYKCPECGKSFSDPG NLVRHQRTHTGEKPYKCPECGKS FSTSGSLVRHQRTHTGEKPTGKK TS | 1731 | $X_1X_2X_3X_4X_5X_6X_7X_8X_9CX_{10}X_{11}CX_{12}X_{13}X_{14}X_{15}X_{16}REDNLHTHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}QSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}DPGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGSLVRHX_{17}X_{18}X_{19}HX_{20}X_{21}X_{22}X_{23}X_{24}X_{25}X_{26}X_{27}X_{28}X_{29}X_{30}$ | 2280 |
| gcaggtgtt gacgatggg caa | 1183 | GCA GGT GTT GAC GAT ggg CAA | LEPGEKPYKCPECGKSFSQSGNL TEHQRTHTGEKPYKCPECGKSFS RSDKLVRHQRTHTGEKPYKCPEC GKSFSTSGNLVRHQRTHTGEKPY KCPECGKSFSDPGNLVRHQRTHT GEKPYKCPECGKSFSTSGSLVRH QRTHTGEKPYKCPECGKSFSTSG HLVRHQRTHTGEKPYKCPECGKS FSQSGDLRRHQRTHTGEKPTGKK TS | 1732 | $X_1X_2X_3X_4X_5X_6X_7X_8X_9CX_{10}X_{11}CX_{12}X_{13}X_{14}X_{15}X_{16}QSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}DPGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGSLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_{25}X_{26}X_{27}X_{28}X_{29}X_{30}$ | 2281 |
| ggtgttgac gatggcaa tgg | 1184 | GGT GTT GAC GAT ggg CAA TGG | LEPGEKPYKCPECGKSFSRSDHL TTHQRTHTGEKPYKCPECGKSFS QSGNLTEHQRTHTGEKPYKCPEC GKSFSRSDKLVRHQRTHTGEKPY KCPECGKSFSTSGNLVRHQRTHT GEKPYKCPECGKSFSDPGNLVRH QRTHTGEKPYKCPECGKSFSTSG SLVRHQRTHTGEKPYKCPECGKS FSTSGHLVRHQRTHTGEKPTGKK TS | 1733 | $X_1X_2X_3X_4X_5X_6X_7X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}QSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}DPGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGSLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_{25}X_{26}X_{27}X_{28}X_{29}X_{30}$ | 2282 |
| gcaatggta ggtggggc aga | 1185 | GCA ATG GTA GGT GGG GGC AGA | LEPGEKPYKCPECGKSFSQLAHL RAHQRTHTGEKPYKCPECGKSFS DPGHLVRHQRTHTGEKPYKCPEC GKSFSRSDKLVRHQRTHTGEKPY KCPECGKSFSTSGHLVRHQRTHT GEKPYKCPECGKSFSQSSLVRH QRTHTGEKPYKCPECGKSFSRRD ELNVHQRTHTGEKPYKCPECGKS FSQSGDLRRHQRTHTGEKPTGKK TS | 1734 | $X_1X_2X_3X_4X_5X_6X_7X_8X_9CX_{10}X_{11}CX_{12}X_{13}X_{14}X_{15}X_{16}QLAHLRAHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSSSLVRHX_{17}X_{18}X_{19}HX_{20}X_{21}X_{22}X_{23}X_{24}X_8X_9CX_{10}X_{11}CX_{12}X_{13}X_{14}X_{15}X_{16}RRDELNVHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_{25}X_{26}X_{27}X_{28}X_{29}X_{30}$ | 2283 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| tgggcaatg gtaggtggg ggc | 1186 | TGG GCA ATG GTA GGT GGG GGC | LEPGEKPYKCPECGKSFSDPGHL VRHQRTHTGEKPYKCPECGKSFS RSDKLVRHQRTHTGEKPYKCPEC GKSFSTSGHLVRHQRTHTGEKPY KCPECGKSFSQSSLVRHQRTHT GEKPYKCPECGKSFSRRDELNVH QRTHTGEKPYKCPECGKSFSQSG DLRRHQRTHTGEKPYKCPECGKS FSRSDHLTTHQRTHTGEKPTGKK TS | 1735 | $X_1X_2X_3X_4X_5X_6X_7X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSSLVRH X_{17}X_{18}X_{19}HX_{20}X_{21}X_{22}X_{23}X_{24}X_8X_9CX_{10}X_{11}CX_{12}X_{13}X_{14}X_{15}X_{16}RRDELN VHX_{17}X_{18}X_{19}HX_{20}X_{21}X_{22}X_{23}X_{24}X_8X_9CX_{10}X_{11}CX_{12}X_{13}X_{14}X_{15}X_{16}SGD LRRHX_{17}X_{18}X_{19}HX_{20}X_{21}X_{22}X_{23}X_{24}X_8X_9CX_{10}X_{11}CX_{12}X_{13}X_{14}X_{15}X_{16}RS DHLTTHX_{17}X_{18}X_{19}HX_{20}K_{21}X_{22}X_{23}X_{24}X_{25}X_{26}X_{27}X_{28}X_{29}X_{30}$ | 2284 |
| tgacgatgg gcatggta ggt | 1187 | TGA CGA TGG GCA ATG GTA GGT | LEPGEKPYKCPECGKSFSTSGHL VRHQRTHTGEKPYKCPECGKSFS QSSSLVRHQRTHTGEKPYKCPEC GKSFSRRDELNVHQRTHTGEKPY KCPECGKSFSQSGDLRRHQRTHT GEKPYKCPECGKSFSRSDHLTTH QRTHTGEKPYKCPECGKSFSQSG HLTEHQRTHTGEKPYKCPECGKS FSQAGHLASHQRTHTGEKPTGKK TS | 1736 | $X_1X_2X_3X_4X_5X_6X_7X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSSLVRHX_{17}X_{18}X_{19}HX_{20}X_{21}X_{22}X_{23}X_{24}X_8X_9CX_{10}X_{11}CX_{12}X_{13}X_{14}X_{15}X_{16}RRDELNVHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRH X_{17}X_{18}X_{19}HX_{20}X_{21}X_{22}X_{23}X_{24}X_8X_9CX_{10}X_{11}CX_{12}X_{13}X_{14}X_{15}X_{16}RSDHLT THX_{17}X_{18}X_{19}HX_{20}X_{21}X_{22}X_{23}X_{24}X_8X_9CX_{10}X_{11}CX_{12}X_{13}X_{14}X_{15}X_{16}QSGH LTEHX_{17}X_{18}X_{19}HX_{20}X_{21}X_{22}X_{23}X_{24}X_8X_9CX_{10}X_{11}CX_{12}X_{13}X_{14}X_{15}X_{16}QA GHLASHX_{17}X_{18}X_{19}HX_{20}X_{21}X_{22}X_{23}X_{24}X_{25}X_{26}X_{27}X_{28}X_{29}X_{30}$ | 2285 |
| cgatgggca atggtaggt ggg | 1188 | CGA TGG GCA ATG GTA GGT GGG | LEPGEKPYKCPECGKSFSRSDKL VRHQRTHTGEKPYKCPECGKSFS TSGHLVRHQRTHTGEKPYKCPEC GKSFSQSSLVRHQRTHTGEKPY KCPECGKSFSRRDELNVHQRTHT GEKPYKCPECGKSFSQSGDLRRH QRTHTGEKPYKCPECGKSFSRSD HLTTHQRTHTGEKPYKCPECGKS FSQSGHLTEHQRTHTGEKPTGKK TS | 1737 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSSLVRHX_{17}X_{18}X_{19}HX_{20}X_{21}X_{22}X_{23}X_{24}X_8X_9CX_{10}X_{11}CX_{12}X_{13}X_{14}X_{15}X_{16}RRDELNVH X_{17}X_{18}X_{19}HX_{20}X_{21}X_{22}X_{23}X_{24}X_8X_9CX_{10}X_{11}CX_{12}X_{13}X_{14}X_{15}X_{16}QSGDLR RHX_{17}X_{18}X_{19}HX_{20}X_{21}X_{22}X_{23}X_{24}X_8X_9CX_{10}X_{11}CX_{12}X_{13}X_{14}X_{15}X_{16}RSDH LTTHX_{17}X_{18}X_{19}HX_{20}X_{21}X_{22}X_{23}X_{24}X_8X_9CX_{10}X_{11}CX_{12}X_{13}X_{14}X_{15}X_{16}QS GHLTEHX_{17}X_{18}X_{19}HX_{20}X_{21}X_{22}X_{23}X_{24}X_{25}X_{26}X_{27}X_{28}X_{29}X_{30}$ | 2286 |
| ggcaatggt aggtgggg cag | 1189 | GGC AAT GGT AGG TGG ggg CAG | LEPGEKPYKCPECGKSFSRADNL TEHQRTHTGEKPYKCPECGKSFS RSDKLVRHQRTHTGEKPYKCPEC GKSFSRSDHLTTHQRTHTGEKPY KCPECGKSFSRSDHLTNHQRTHT GEKPYKCPECGKSFSTSGHLVRH QRTHTGEKPYKCPECGKSFSTTG NLTVHQRTHTGEKPYKCPECGKS FSDPGHLVRHQRTHTGEKPTGKK TS | 1738 | $X_1X_2X_3X_4X_5X_6X_7X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNH X_{17}X_{18}X_{19}HX_{20}X_{21}X_{22}X_{23}X_{24}X_8X_9CX_{10}X_{11}CX_{12}X_{13}X_{14}X_{15}X_{16}TSGHLV RHX_{17}X_{18}X_{19}HX_{20}X_{21}X_{22}X_{23}X_{24}X_8X_9CX_{10}X_{11}CX_{12}X_{13}X_{14}X_{15}X_{16}TTGN LTVHX_{17}X_{18}X_{19}HX_{20}X_{21}X_{22}X_{23}X_{24}X_8X_9CX_{10}X_{11}CX_{12}X_{13}X_{14}X_{15}X_{16}DP GHLVRHX_{17}X_{18}X_{19}HX_{20}X_{21}X_{22}X_{23}X_{24}X_{25}X_{26}X_{27}X_{28}X_{29}X_{30}$ | 2287 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| atggcaat ggtaggtgg ggg | 1190 | ATG GGC AAT GGT AGG TGG GGG | LEPGEKPYKCPECGKSFSRSDKL VRHQRTHTGEKPYKCPECGKSFS RSDHLTTHQRTHTGEKPYKCPEC GKSFSRSDHLTNHQRTHTGEKPY KCPECGKSFSTSGHLVRHQRTHT GEKPYKCPECGKSFSTTGNLTVH QRTHTGEKPYKCPECGKSFSDPG HLVRHQRTHTGEKPYKCPECGKS FSRRDELNVHQRTHTGEKPTGKK TS | 1739 | $XX_2X_3X_4X_5X_6X_7X_8X_9CX_{10}X_{11}CX_{12}X_{13}X_{14}X_{15}X_{16}RSDKLVRHX_{17}X_{18}X_{19}$ $HX_{20}X_{21}X_{22}X_{23}X_{24}X_8X_9CX_{10}X_{11}CX_{12}X_{13}X_{14}X_{15}X_{16}RSDHLTTHX_{17}X_{18}$ $X_{19}HX_{20}X_{21}X_{22}X_{23}X_{24}X_8X_9CX_{10}X_{11}CX_{12}X_{13}X_{14}X_{15}X_{16}RSDHLTNHX_{17}$ $X_{18}X_{19}HX_{20}X_{21}X_{22}X_{23}X_{24}X_8X_9CX_{10}X_{11}CX_{12}X_{13}X_{14}X_{15}X_{16}TSGHLVRH$ $X_{17}X_{18}X_{19}HX_{20}X_{21}X_{22}X_{23}X_{24}X_8X_9CX_{10}X_{11}CX_{12}X_{13}X_{14}X_{15}X_{16}TTGNLT$ $VHX_{17}X_{18}X_{19}HX_{20}X_{21}X_{22}X_{23}X_{24}X_8X_9CX_{10}X_{11}CX_{12}X_{13}X_{14}X_{15}X_{16}DPGH$ $LVRHX_{17}X_{18}X_{19}HX_{20}X_{21}X_{22}X_{23}X_{24}X_8X_9CX_{10}X_{11}CX_{12}X_{13}X_{14}X_{15}X_{16}RR$ $DELNVHX_{17}X_{18}X_{19}HX_{20}X_{21}X_{22}X_{23}X_{24}X_{25}X_{26}X_{27}X_{28}X_{29}X_{30}$ | 2288 |
| aatggtagg tggggcag atg | 1191 | AAT GGT AGG TGG ggg CAG ATG | LEPGEKPYKCPECGKSFSRRDEL NVHQRTHTGEKPYKCPECGKSFS RADNLTEHQRTHTGEKPYKCPEC GKSFSRSDKLVRHQRTHTGEKPY KCPECGKSFSRSDHLTTHQRTHT GEKPYKCPECGKSFSRSDHLTNH QRTHTGEKPYKCPECGKSFSTSG HLVRHQRTHTGEKPYKCPECGKS FSTTGNLTVHQRTHTGEKPTGKK TS | 1740 | $X_1X_2X_3X_4X_5X_6X_7X_8X_9CX_{10}X_{11}CX_{12}X_{13}X_{14}X_{15}X_{16}RRDELNVHX_{17}X_{18}X_{19}$ $HX_{20}X_{21}X_{22}X_{23}X_{24}X_8X_9CX_{10}X_{11}CX_{12}X_{13}X_{14}X_{15}X_{16}RADNLTEHX_{17}X_{18}$ $X_{19}HX_{20}X_{21}X_{22}X_{23}X_{24}X_8X_9CX_{10}X_{11}CX_{12}X_{13}X_{14}X_{15}X_{16}RSDKLVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}RSDHLTTH$ $NHX_{17}X_{18}X_{19}HX_{20}X_{21}X_{22}X_{23}X_{24}X_8X_9CX_{10}X_{11}CX_{12}X_{13}X_{14}X_{15}X_{16}TSGH$ $LVRHX_{17}X_{18}X_{19}HX_{20}X_{21}X_{22}X_{23}X_{24}X_8X_9CX_{10}X_{11}CX_{12}X_{13}X_{14}X_{15}X_{16}TT$ $GNLTVHX_{17}X_{18}X_{19}HX_{20}X_{21}X_{22}X_{23}X_{24}X_{25}X_{26}X_{27}X_{28}X_{29}X_{30}$ | 2289 |
| acgatgggc aatggtagg tgg | 1192 | ACG ATG GGC AAT GGT AGG TGG | LEPGEKPYKCPECGKSFSRSDHL TTHQRTHTGEKPYKCPECGKSFS RSDHLTNHQRTHTGEKPYKCPEC GKSFSTSGHLVRHQRTHTGEKPY KCPECGKSFSTTGNLTVHQRTHT GEKPYKCPECGKSFSDPGHLVRH QRTHTGEKPYKCPECGKSFSRRD ELNVHQRTHTGEKPYKCPECGKS FSRTDTLRDHQRTHTGEKPTGKK TS | 1741 | $X_1X_2X_3X_4X_5X_6X_7X_8X_9CX_{10}X_{11}CX_{12}X_{13}X_{14}X_{15}X_{16}RSDHLTTHX_{17}X_{18}X_{19}$ $HX_{20}X_{21}X_{22}X_{23}X_{24}X_8X_9CX_{10}X_{11}CX_{12}X_{13}X_{14}X_{15}X_{16}RSDHLTNHX_{17}X_{18}$ $X_{19}HX_{20}X_{21}X_{22}X_{23}X_{24}X_8X_9CKX_{10}X_{11}CX_{12}X_{13}X_{14}X_{15}X_{16}TSGHLVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}TTGNLTVH$ $X_{17}X_{18}X_{19}HX_{20}X_{21}X_{22}X_{23}X_{24}X_8X_9CX_{10}X_{11}CX_{12}X_{13}X_{14}X_{15}X_{16}DPGHLV$ $RHX_{17}X_{18}X_{19}HX_{20}X_{21}X_{22}X_{23}X_{24}X_8X_9CX_{10}X_{11}CX_{12}X_{13}X_{14}X_{15}X_{16}RRDE$ $LNVHX_{17}X_{18}X_{19}HX_{20}X_{21}X_{22}X_{23}X_{24}X_8X_9CX_{10}X_{11}CX_{12}X_{13}X_{14}X_{15}X_{16}RT$ $DTLRDHX_{17}X_{18}X_{19}HX_{20}X_{21}X_{22}X_{23}X_{24}X_{25}X_{26}X_{27}X_{28}X_{29}X_{30}$ | 2290 |
| gtggggca ggtgcct ggg | 1193 | GTG GGG GCA gtg CCT GGG | LEPGEKPYKCPECGKSFSRSDKL VRHQRTHTGEKPYKCPECGKSFS TKNSLTEHQRTHTGEKPYKCPEC GKSFSRSDELVRHQRTHTGEKPY KCPECGKSFSTSGHLVRHQRTHT GEKPYKCPECGKSFSQSGDLRRH QRTHTGEKPYKCPECGKSFSRSD KLVRHQRTHTGEKPYKCPECGKS FSRSDELVRHQRTHTGEKPTGKK TS | 1742 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}$ $HX_{20}X_{21}X_{22}X_{23}X_{24}X_8X_9CX_{10}X_{11}CX_{12}X_{13}X_{14}X_{15}X_{16}TKNSLTEHX_{17}X_{18}$ $X_{19}HX_{20}X_{21}X_{22}X_{23}X_{24}X_8X_9CX_{10}X_{11}CX_{12}X_{13}X_{14}X_{15}X_{16}RSDELVRHX_{17}$ $X_{18}X_{19}HX_{20}X_{21}X_{22}X_{23}X_{24}X_8X_9CX_{10}X_{11}CX_{12}X_{13}X_{14}X_{15}KX_{16}TSGHLVRH$ $X_{17}X_{18}X_{19}HX_{20}X_{21}X_{22}X_{23}X_{24}X_8X_9CX_{10}X_{11}CX_{12}X_{13}X_{14}X_{15}X_{16}QSGDLR$ $RHX_{17}X_{18}X_{19}HX_{20}X_{21}X_{22}X_{23}X_{24}X_8X_9CX_{10}X_{11}CX_{12}X_{13}X_{14}X_{15}X_{16}RSDK$ $LVRHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DELVRHX_{17}X_{18}X_{19}HX_{20}X_{21}X_{22}X_{23}X_{24}X_{25}X_{26}X_{27}X_{28}X_{29}X_{30}$ | 2291 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| ccagtgggg gcagtgtg cct | 1194 | CCA GTG GGG GCA GGT GGT CCT | LEPGEKPYKCPECGKSFSTKNSL TEHQRTHTGEKPYKCPECGKSFS RSDELVRHQRTHTGEKPYKCPEC GKSFSTSGHLVRHQRTHTGEKPY KCPECGKSFSQSGDLRRHQRTHT GEKPYKCPECGKSFSRSDKLVRH QRTHTGEKPYKCPECGKSFSRSD ELVRHQRTHTGEKPYKCPECGKS FSTSHSLTEHQRTHTGEKPTGKK TS | 1743 | $X_1X_2X_3X_4X_5X_6X_7X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_{25}X_{26}X_{27}X_{28}X_{29}X_{30}HSLTEHX_{17}X_{18}X_{19}HX_{20}X_{21}X_{22}X_{23}X_{24}X_{25}X_{26}X_{27}X_{28}X_{29}X_{30}$ | 2292 |
| gtgcagtg gggcaggt gtg | 1195 | gtg CCA GTG GGG GCA GGT GTG | LEPGEKPYKCPECGKSFSRSDEL VRHQRTHTGEKPYKCPECGKSFS TSGHLVRHQRTHTGEKPYKCPEC GKSFSQSGDLRRHQRTHTGEKPY KCPECGKSFSRSDKLVRHQRTHT GEKPYKCPECGKSFSRSDELVRH QRTHTGEKPYKCPECGKSFSTSH SLTEHQRTHTGEKPYKCPECGKS FSRSDELVRHQRTHTGEKPTGKK TS | 1744 | $X_1X_2X_3X_4X_5X_6X_7X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_{25}X_{26}X_{27}X_{28}X_{29}X_{30}$ | 2293 |
| ccagtgtg ccagtgggg gca | 1196 | CCA GGT gtg CCA GTG GGG GCA | LEPGEKPYKCPECGKSFSQSGDL RRHQRTHTGEKPYKCPECGKSFS RSDKLVRHQRTHTGEKPYKCPEC GKSFSRSDELVRHQRTHTGEKPY KCPECGKSFSTSHSLTEHQRTHT GEKPYKCPECGKSFSRSDELVRH QRTHTGEKPYKCPECGKSFSTSG HLVRHQRTHTGEKPYKCPECGKS FSTSHSLTEHQRTHTGEKPTGKK TS | 1745 | $X_1X_2X_3X_4X_5X_6X_7X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_{25}X_{26}X_{27}X_{28}X_{29}X_{30}HSLTEHX_{17}X_{18}X_{19}HX_{20}X_{21}X_{22}X_{23}X_{24}X_{25}X_{26}X_{27}X_{28}X_{29}X_{30}$ | 2294 |
| ggtgtgcca gtggggca ggt | 1197 | GGT gtg CCA GTG GGG GCA GGT | LEPGEKPYKCPECGKSFSTSGHL VRHQRTHTGEKPYKCPECGKSFS QSGDLRRHQRTHTGEKPYKCPEC GKSFSRSDKLVRHQRTHTGEKPY KCPECGKSFSRSDELVRHQRTHT GEKPYKCPECGKSFSTSHSLTEH QRTHTGEKPYKCPECGKSFSRSD ELVRHQRTHTGEKPYKCPECGKS FSTSGHLVRHQRTHTGEKPTGKK TS | 1746 | $X_1X_2X_3X_4X_5X_6X_7X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_{25}X_{26}X_{27}X_{28}X_{29}X_{30}$ | 2295 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| ccaggagca gatcttgg cac | 1198 | CCA GGA GCA GAT CTT TGG CAC | LEPGEKPYKCPECGKSFSSKKAL TEHQRTHTGEKPYKCPECGKSFS RSDHLTTHQRTHTGEKPYKCPEC GKSFSTTGALTEHQRTHTGEKPY KCPECGKSFSTSGNLVRHQRTHT GEKPYKCPECGKSFSQSGDLRRH QRTHTGEKPYKCPECGKSFSQRA HLERHQRTHTGEKPYKCPECGKS FSTSHSLTEHQRTHTGEKPTGKK TS | 1747 | $X_1X_2X_3X_4X_5X_6X_7X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}TTGALTEHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLVRH X_{17}X_{18}X_{19}HX_{20}X_{21}X_{22}X_{23}X_{24}X_8X_9CX_{10}X_{11}CX_{12}X_{13}X_{14}X_{15}X_{16}QSGDLR RHX_{17}X_{18}X_{19}HX_{20}X_{21}X_{22}X_{23}X_{24}X_8X_9CX_{10}X_{11}CX_{12}X_{13}X_{14}X_{15}X_{16}QRAH LERHX_{17}X_{18}X_{19}HX_{20}X_{21}X_{22}X_{23}X_{24}X_8X_9CX_{10}X_{11}CX_{12}X_{13}X_{14}X_{15}X_{16}TS HSLTEHX_{17}X_{18}X_{19}HX_{20}X_{21}X_{22}X_{23}X_{24}X_{25}X_{26}X_{27}X_{28}X_{29}X_{30}$ | 2296 |
| ctgggtcca ggacagat ctt | 1199 | CTG GGT CCA GGA GCA GAT CTT | LEPGEKPYKCPECGKSFSTTGAL TEHQRTHTGEKPYKCPECGKSFS TSGNLVRHQRTHTGEKPYKCPEC GKSFSQSGDLRRHQRTHTGEKPY KCPECGKSFSQRAHLERHQRTHT GEKPYKCPECGKSFSTSHSLTEH QRTHTGEKPYKCPECGKSFSTSG HLVRHQRTHTGEKPYKCPECGKS FSRNDALTEHQRTHTGEKPTGKK TS | 1748 | $X_1X_2X_3X_4X_5X_6X_7X_8X_9CX_{10}X_{11}CX_{12}X_{13}X_{14}X_{15}X_{16}TTGALTEHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLT EHX_{17}X_{18}X_{19}HX_{20}X_{21}X_{22}X_{23}X_{24}X_8X_9CX_{10}X_{11}CX_{12}X_{13}X_{14}X_{15}X_{16}TSGH LVRHX_{17}X_{18}X_{19}HX_{20}X_{21}X_{22}X_{23}X_{24}X_8X_9CX_{10}X_{11}CX_{12}X_{13}X_{14}X_{15}X_{16}RN DALTEHX_{17}X_{18}X_{19}HX_{20}X_{21}X_{22}X_{23}X_{24}X_{25}X_{26}X_{27}X_{28}X_{29}X_{30}$ | 2297 |
| ggtccagga gcagatctt tgg | 1200 | GGT CCA GGA GCA GAT CTT TGG | LEPGEKPYKCPECGKSFSRSDHL TTHQRTHTGEKPYKCPECGKSFS TTGALTEHQRTHTGEKPYKCPEC GKSFSTSGNLVRHQRTHTGEKPY KCPECGKSFSQSGDLRRHQRTHT GEKPYKCPECGKSFSQRAHLERH QRTHTGEKPYKCPECGKSFSTSH SLTEHQRTHTGEKPYKCPECGKS FSTSGHLVRHQRTHTGEKPTGKK TS | 1749 | $X_1X_2X_3X_4X_5X_6X_7X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}TTGALTEHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRH X_{17}X_{18}X_{19}HX_{20}X_{21}X_{22}X_{23}X_{24}X_8X_9CX_{10}X_{11}CX_{12}X_{13}X_{14}X_{15}X_{16}QRAHLE RHX_{17}X_{18}X_{19}HX_{20}X_{21}X_{22}X_{23}X_{24}X_8X_9CX_{10}X_{11}CX_{12}X_{13}X_{14}X_{15}X_{16}TSHS LTEHX_{17}X_{18}X_{19}HX_{20}X_{21}X_{22}X_{23}X_{24}X_8X_9CX_{10}X_{11}CX_{12}X_{13}X_{14}X_{15}X_{16}TS GHLVRHX_{17}X_{18}X_{19}HX_{20}X_{21}X_{22}X_{23}X_{24}X_{25}X_{26}X_{27}X_{28}X_{29}X_{30}$ | 2298 |
| ggggaggaga atgatacaa aat | 1201 | ggg AGG AGA ATG ATA CAA AAT | LEPGEKPYKCPECGKSFSTTGNL TVHQRTHTGEKPYKCPECGKSFS QSGNLTEHQRTHTGEKPYKCPEC GKSFSQKSSLIAHQRTHTGEKPY KCPECGKSFSRRDELNVHQRTHT GEKPYKCPECGKSFSQLAHLRAH QRTHTGEKPYKCPECGKSFSRSD HLTNHQRTHTGEKPYKCPECGKS FSRSDKLVRHQRTHTGEKPTGKK TS | 1750 | $X_1X_2X_3X_4X_5X_6X_7X_8X_9CX_{10}X_{11}CX_{12}X_{13}X_{14}X_{15}X_{16}TTGNLTVHX_{17}X_{18}X_{19}9HX_{20}X_{21}X_{22}X_{23}X_{24}X_8X_9CX_{10}X_{11}CX_{12}X_{13}X_{14}X_{15}X_{16}QSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}QKSSLIAHX_{17}X_{18}X_{19}HX_{20}X_{21}X_{22}X_{23}X_{24}X_8X_9CX_{10}X_{11}CX_{12}X_{13}X_{14}X_{15}X_{16}RRDELNVH X_{17}X_{18}X_{19}HX_{20}X_{21}X_{22}X_{23}X_{24}X_8X_9CX_{10}X_{11}CX_{12}X_{13}X_{14}X_{15}X_{16}QLAHLR AHX_{17}X_{18}X_{19}HX_{20}X_{21}X_{22}X_{23}X_{24}X_8X_9CX_{10}X_{11}CX_{12}X_{13}X_{14}X_{15}X_{16}RSDH LTNHX_{17}X_{18}X_{19}HX_{20}X_{21}X_{22}X_{23}X_{24}X_8X_9CX_{10}X_{11}CX_{12}X_{13}X_{14}X_{15}X_{16}RS DKLVRHX_{17}X_{18}X_{19}HX_{20}X_{21}X_{22}X_{23}X_{24}X_{25}X_{26}X_{27}X_{28}X_{29}X_{30}$ | 2299 |

TABLE 10-continued

| Column 1 Nucleotide Sequence of Target Site in HNF4α Expression Control Region | Column 3 Target sequence with space | Column 2 SEQ ID NO. (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| tgggtggg aggagaatg ata | TGG GGT ggg AGG AGA ATG ATA | 1202 | LEPGEKPYKCPECGKSFSQKSSL IAHQRTHTGEKPYKCPECGKSFS RRDELNVHQRTHTGEKPYKCPEC GKSFSQLAHLRAHQRTHTGEKPY KCPECGKSFSRSDHLTNHQRTHT GEKPYKCPECGKSFSRDKLVRH QRTHTGEKPYKCPECGKSFSTSG HLVRHQRTHTGEKPYKCPECGKS FSRSDHLTTHQRTHTGEKPTGKK TS | 1751 | $X_1X_2X_3X_4X_5X_6X_7X_8X_9CX_{10}X_{11}CX_{12}X_{13}X_{14}X_{15}X_{16}QKSSLIAHX_{17}X_{18}X_{19}HX_{20}X_{21}X_{22}X_{23}X_{24}X_8X_9CX_{10}X_{11}CX_{12}X_{13}X_{14}X_{15}X_{16}RRDELNVHX_{17}X_{18}X_{19}HX_{20}X_{21}X_{22}X_{23}X_{24}X_8X_9CX_{10}X_{11}CX_{12}X_{13}X_{14}X_{15}X_{16}QLAHLRAHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNH X_{17}X_{18}X_{19}HX_{20}X_{21}X_{22}X_{23}X_{24}X_8X_9CX_{10}X_{11}CX_{12}X_{13}X_{14}X_{15}X_{16}RSDKLV RHX_{17}X_{18}X_{19}HX_{20}X_{21}X_{22}X_{23}X_{24}X_8X_9CX_{10}X_{11}CX_{12}X_{13}X_{14}X_{15}X_{16}TSGH LVRHX_{17}X_{18}X_{19}HX_{20}X_{21}X_{22}X_{23}X_{24}X_8X_9CX_{10}X_{11}CX_{12}X_{13}X_{14}X_{15}X_{16}RS DHLTTHX_{17}X_{18}X_{19}HX_{20}X_{21}X_{22}X_{23}X_{24}X_{25}X_{26}X_{27}X_{28}X_{29}X_{30}$ | 2300 |
| ctttgggt gggagaga atg | CTT TGG GGT ggg AGG AGA ATG | 1203 | LEPGEKPYKCPECGKSFSRRDEL NVHQRTHTGEKPYKCPECGKSFS QLAHLRAHQRTHTGEKPYKCPEC GKSFSRSDHLTNHQRTHTGEKPY KCPECGKSFSRSDKLVRHQRTHT GEKPYKCPECGKSFSTSGHLVRH QRTHTGEKPYKCPECGKSFSRSD HLTTHQRTHTGEKPYKCPECGKS FSTTGALTEHQRTHTGEKPTGKK TS | 1752 | $X_1X_2X_3X_4X_5X_6X_7X_8X_9CX_{10}X_{11}CX_{12}X_{13}X_{14}X_{15}X_{16}RRDELNVHX_{17}X_{18}X_{19}HX_{20}X_{21}X_{22}X_{23}X_{24}X_8X_9CX_{10}X_{11}CX_{12}X_{13}X_{14}X_{15}X_{16}QLAHLRAHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRH X_{17}X_{18}X_{19}HX_{20}X_{21}X_{22}X_{23}X_{24}X_8X_9CX_{10}X_{11}CX_{12}X_{13}X_{14}X_{15}X_{16}TSGHLV RHX_{17}X_{18}X_{19}HX_{20}X_{21}X_{22}X_{23}X_{24}X_8X_9CX_{10}X_{11}CX_{12}X_{13}X_{14}X_{15}X_{16}RSDH LTTHX_{17}X_{18}X_{19}HX_{20}X_{21}X_{22}X_{23}X_{24}X_8X_9CX_{10}X_{11}CX_{12}X_{13}X_{14}X_{15}X_{16}TT GALTEHX_{17}X_{18}X_{19}HX_{20}X_{21}X_{22}X_{23}X_{24}X_{25}X_{26}X_{27}X_{28}X_{29}X_{30}$ | 2301 |
| ggcactcaa ctttgggt ggg | GGC ACT CAA CTT TGG GGT GGG | 1204 | LEPGEKPYKCPECGKSFSRSDKL VRHQRTHTGEKPYKCPECGKSFS TSGHLVRHQRTHTGEKPYKCPEC GKSFSRSDHLTTHQRTHTGEKPY KCPECGKSFSTTGALTEHQRTHT GEKPYKCPECGKSFSQSGNLTEH QRTHTGEKPYKCPECGKSFSTHL DLIRHQRTHTGEKPYKCPECGKS FSDPGHLVRHQRTHTGEKPTGKK TS | 1753 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}TTGALTEH X_{17}X_{18}X_{19}HX_{20}X_{21}X_{22}X_{23}X_{24}X_8X_9CX_{10}X_{11}CX_{12}X_{13}X_{14}X_{15}X_{16}QSGNLT EHX_{17}X_{18}X_{19}HX_{20}X_{21}X_{22}X_{23}X_{24}X_8X_9CX_{10}X_{11}CX_{12}X_{13}X_{14}X_{15}X_{16}THLD LIRHX_{17}X_{18}X_{19}HX_{20}X_{21}X_{22}X_{23}X_{24}X_8X_9CX_{10}X_{11}CX_{12}X_{13}X_{14}X_{15}X_{16}DP GHLVRHX_{17}X_{18}X_{19}HX_{20}X_{21}X_{22}X_{23}X_{24}X_{25}X_{26}X_{27}X_{28}X_{29}X_{30}$ | 2302 |
| aggagaatg atacaaaat ggt | AGG AGA ATG ATA CAA AAT GGT | 1205 | LEPGEKPYKCPECGKSFSTSGHL VRHQRTHTGEKPYKCPECGKSFS TTGNLTVHQRTHTGEKPYKCPEC GKSFSQSGNLTEHQRTHTGEKPY KCPECGKSFSQKSSLIAHQRTHT GEKPYKCPECGKSFSRRDELNVH QRTHTGEKPYKCPECGKSFSQLA HLRAHQRTHTGEKPYKCPECGKS FSRSDHLTNHQRTHTGEKPTGKK TS | 1754 | $X_1X_2X_3X_4X_5X_6X_7X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}TTGNLTVHX_{17}X_{18}X_{19}HX_{20}X_{21}X_{22}X_{23}X_{24}X_8X_9CX_{10}X_{11}CX_{12}X_{13}X_{14}X_{15}X_{16}QSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}QKSSLIAH X_{17}X_{18}X_{19}HX_{20}X_{21}X_{22}X_{23}X_{24}X_8X_9CX_{10}X_{11}CX_{12}X_{13}X_{14}X_{15}X_{16}RRDELN VHX_{17}X_{18}X_{19}HX_{20}X_{21}X_{22}X_{23}X_{24}X_8X_9CX_{10}X_1CX_{12}X_{13}X_{14}X_{15}X_{16}QLAH LRAHX_{17}X_{18}X_{19}HX_{20}X_{21}X_{22}X_{23}X_{24}X_8X_9CX_{10}X_{11}CX_{12}X_{13}X_{14}X_{15}X_{16}RS DHLTNHX_{17}X_{18}X_{19}HX_{20}X_{21}X_{22}X_{23}X_{24}X_{25}X_{26}X_{27}X_{28}X_{29}X_{30}$ | 2303 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| agaatgata caaaatggt agg | 1206 | AGA ATG ATA CAA AAT GGT AGG | LEPGEKPYKCPECGKSFSRSDHL TNHQRTHTGEKPYKCPECGKSFS TSGHLVRHQRTHTGEKPYKCPEC GKSFSTTGNLTVHQRTHTGEKPY KCPECGKSFSQSGNLTEHQRTHT GEKPYKCPECGKSFSQKSSLIAH QRTHTGEKPYKCPECGKSFSRRD ELNVHQRTHTGEKPYKCPECGKS FSQLAHLRAHQRTHTGEKPTGKK TS | 1755 | $X_1X_2X_3X_4X_5X_6X_7X_8X_9CX_{10}X_{11}CX_{12}X_{13}X_{14}X_{15}X_{16}RSDHLTNHX_{17}X_{18}X_{19}$ $HX_{20}X_{21}X_{22}X_{23}X_{24}X_8X_9CX_{10}X_{11}CX_{12}X_{13}X_{14}X_{15}X_{16}TSGHLVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}TTGNLTVHX_{17}$ $X_{18}X_{19}HX_{20}X_{21}X_{22}X_{23}X_{24}X_8X_9CX_{10}X_{11}CX_{12}X_{13}X_{14}X_{15}X_{16}QSGNLTEH$ $X_{17}X_{18}X_{19}HX_{20}X_{21}X_{22}X_{23}X_{24}X_8X_9CX_{10}X_{11}CX_{12}X_{13}X_{14}X_{15}X_{16}QKSSLI$ $AHX_{17}X_{18}X_{19}HX_{20}X_{21}X_{22}X_{23}X_{24}X_8X_9CX_{10}X_{11}CX_{12}X_{13}X_{14}X_{15}X_{16}RRDE$ $LNVHX_{17}X_{18}X_{19}HX_{20}X_{21}X_{22}X_{23}X_{24}X_8X_9CX_{10}X_{11}CX_{12}X_{13}X_{14}X_{15}X_{16}QL$ $AHLRAHX_{17}X_{18}X_{19}HX_{20}X_{21}X_{22}X_{23}X_{24}X_{25}X_{26}X_{27}X_{28}X_{29}X_{30}$ | 2304 |
| ggtgggagg agatgata caa | 1207 | GGT ggg AGG AGA ATG ATA CAA | LEPGEKPYKCPECGKSFSQSGNL TEHQRTHTGEKPYKCPECGKSFS QKSSLIAHQRTHTGEKPYKCPEC GKSFSRRDELNVHQRTHTGEKPY KCPECGKSFSQLAHLRAHQRTHT GEKPYKCPECGKSFSRSDHLTNH QRTHTGEKPYKCPECGKSFSRSD KLVRHQRTHTGEKPYKCPECGKS FSTSGHLVRHQRTHTGEKPTGKK TS | 1756 | $X_1X_2X_3X_4X_5X_6X_7X_8X_9CX_{10}X_{11}CX_{12}X_{13}X_{14}X_{15}X_{16}QSGNLTEHX_{17}X_{18}X_{19}$ $HX_{20}X_{21}X_{22}X_{23}X_{24}X_8X_9CX_{10}X_{11}CX_{12}X_{13}X_{14}X_{15}X_{16}QKSSLIAHX_{17}X_{18}$ $X_{19}HX_{20}X_{21}X_{22}X_{23}X_{24}X_8X_9CX_{10}X_{11}CX_{12}X_{13}X_{14}X_{15}X_{16}RRDELNVHX_{17}$ $X_{18}X_{19}HX_{20}X_{21}X_{22}X_{23}X_{24}X_8X_9CX_{10}X_{11}CX_{12}X_{13}X_{14}X_{15}X_{16}QLAHLRAH$ $X_{17}X_{18}X_{19}HX_{20}X_{21}X_{22}X_{23}X_{24}X_8X_9CX_{10}X_{11}CX_{12}X_{13}X_{14}X_{15}X_{16}RSDHLT$ $NHX_{17}X_{18}X_{19}HX_{20}X_{21}X_{22}X_{23}X_{24}X_8X_9CX_{10}X_{11}CX_{12}X_{13}X_{14}X_{15}X_{16}RSDK$ $LVRHX_{17}X_{18}X_{19}HX_{20}X_{21}X_{22}X_{23}X_{24}X_8X_9CX_{10}X_{11}CX_{12}X_{13}X_{14}X_{15}X_{16}TS$ $GHLVRHX_{17}X_{18}X_{19}HX_{20}X_{21}X_{22}X_{23}X_{24}X_{25}X_{26}X_{27}X_{28}X_{29}X_{30}$ | 2305 |
| caactttgg ggtgggagg aga | 1208 | CAA CTT TGG ggg AGG AGA | LEPGEKPYKCPECGKSFSQLAHL RAHQRTHTGEKPYKCPECGKSFS RSDHLTNHQRTHTGEKPYKCPEC GKSFSRSDKLVRHQRTHTGEKPY KCPECGKSFSTSGHLVRHQRTHT GEKPYKCPECGKSFSRSDHLTTH QRTHTGEKPYKCPECGKSFSTTG ALTEHQRTHTGEKPYKCPECGKS FSQSGNLTEHQRTHTGEKPTGKK TS | 1757 | $X_1X_2X_3X_4X_5X_6X_7X_8X_9CX_{10}X_{11}CX_{12}X_{13}X_{14}X_{15}X_{16}QLAHLRAHX_{17}X_{18}X_{19}$ $HX_{20}X_{21}X_{22}X_{23}X_{24}X_8X_9CX_{10}X_{11}CX_{12}X_{13}X_{14}X_{15}X_{16}RSDHLTNHX_{17}X_{18}$ $X_{19}HX_{20}X_{21}X_{22}X_{23}X_{24}X_8X_9CX_{10}X_{11}CX_{12}X_{13}X_{14}X_{15}X_{16}RSDKLVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}TSGHLVRH$ $X_{17}X_{18}X_{19}HX_{20}X_{21}X_{22}X_{23}X_{24}X_8X_9CX_{10}X_{11}CX_{12}X_{13}X_{14}X_{15}X_{16}RSDHLT$ $THX_{17}X_{18}X_{19}HX_{20}X_{21}X_{22}X_{23}X_{24}X_8X_9CX_{10}X_{11}CX_{12}X_{13}X_{14}X_{15}X_{16}TTGA$ $LTEHX_{17}X_{18}X_{19}HX_{20}X_{21}X_{22}X_{23}X_{24}X_8X_9CX_{10}X_{11}CX_{12}X_{13}X_{14}X_{15}X_{16}QS$ $GNLTEHX_{17}X_{18}X_{19}HX_{20}X_{21}X_{22}X_{23}X_{24}X_{25}X_{26}X_{27}X_{28}X_{29}X_{30}$ | 2306 |
| actcaactt tggggtggg agg | 1209 | ACT CAA CTT TGG GGT ggg AGG | LEPGEKPYKCPECGKSFSRSDHL TNHQRTHTGEKPYKCPECGKSFS RSDKLVRHQRTHTGEKPYKCPEC GKSFSTSGHLVRHQRTHTGEKPY KCPECGKSFSRSDHLTTHQRTHT GEKPYKCPECGKSFSTTGALTEH QRTHTGEKPYKCPECGKSFSQSG NLTEHQRTHTGEKPYKCPECGKS FSTHLDLIRHQRTHTGEKPTGKK TS | 1758 | $X_1X_2X_3X_4X_5X_6X_7X_8X_9CX_{10}X_{11}CX_{12}X_{13}X_{14}X_{15}X_{16}RSDHLTNHX_{17}X_{18}X_{19}$ $HX_{20}X_{21}X_{22}X_{23}X_{24}X_8X_9CX_{10}X_{11}CX_{12}X_{13}X_{14}X_{15}X_{16}RSDKLVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}TSGHLVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}RSDHLTTH$ $X_{17}X_{18}X_{19}HX_{20}X_{21}X_{22}X_{23}X_{24}X_8X_9CX_{10}X_{11}CX_{12}X_{13}X_{14}X_{15}X_{16}TTGALT$ $EHX_{17}X_{18}X_{19}HX_{20}X_{21}X_{22}X_{23}X_{24}X_8X_9CX_{10}X_{11}CX_{12}X_{13}X_{14}X_{15}X_{16}QSGN$ $LTEHX_{17}X_{18}X_{19}HX_{20}X_{21}X_{22}X_{23}X_{24}X_8X_9CX_{10}X_{11}CX_{12}X_{13}X_{14}X_{15}X_{16}TH$ $LDLIRHX_{17}X_{18}X_{19}HX_{20}X_{21}X_{22}X_{23}X_{24}X_{25}X_{26}X_{27}X_{28}X_{29}X_{30}$ | 2307 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gggtgggag gagaatgat aca | 1210 | GGG TGG GAG GAG AAT GAT ACA | LEPGEKPYKCPECGKSFSSPADL TRHQRTHTGEKPYKCPECGKSFS TSGNLVRHQRTHTGEKPYKCPEC GKSFSTTGNLTVHQRTHTGEKPY KCPECGKSFSRSDNLVRHQRTHT GEKPYKCPECGKSFSRSDNLVRH QRTHTGEKPYKCPECGKSFSRSD HLTTHQRTHTGEKPYKCPECGKS FSRSDKLVRHQRTHTGEKPTGKK TS | 1759 | $X_1X_2X_3X_4X_5X_6X_7X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}TTGNLTVHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_{25}X_{26}X_{27}X_{28}X_{29}X_{30}$ | 2308 |
| gagaatgat acaaaatgg tag | 1211 | gag AAT GAT ACA AAA TGG TAG | LEPGEKPYKCPECGKSFSREDNL HTHQRTHTGEKPYKCPECGKSFS RSDHLTTHQRTHTGEKPYKCPEC GKSFSQRANLRAHQRTHTGEKPY KCPECGKSFSSPADLTRHQRTHT GEKPYKCPECGKSFSTSGNLVRH QRTHTGEKPYKCPECGKSFSTTG NLTVHQRTHTGEKPYKCPECGKS FSRSDNLVRHQRTHTGEKPTGKK TS | 1760 | $X_1X_2X_3X_4X_5X_6X_7X_8X_9CX_{10}X_{11}CX_{12}X_{13}X_{14}X_{15}X_{16}REDNLHTHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}QRANLRAHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}TTGNLTVHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_{25}X_{26}X_{27}X_{28}X_{29}X_{30}$ | 2309 |
| tggaggag aatgataca aaa | 1212 | TGG GAG gag AAT GAT ACA AAA | LEPGEKPYKCPECGKSFSQRANL RAHQRTHTGEKPYKCPECGKSFS SPADLTRHQRTHTGEKPYKCPEC GKSFSTSGNLVRHQRTHTGEKPY KCPECGKSFSTTGNLTVHQRTHT GEKPYKCPECGKSFSRSDNLVRH QRTHTGEKPYKCPECGKSFSRSD NLVRHQRTHTGEKPYKCPECGKS FSRSDHLTTHQRTHTGEKPTGKK TS | 1761 | $X_1X_2X_3X_4X_5X_6X_7X_8X_9CX_{10}X_{11}CX_{12}X_{13}X_{14}X_{15}X_{16}QRANLRAHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}TTGNLTVHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_{25}X_{26}X_{27}X_{28}X_{29}X_{30}$ | 2310 |
| gaggagaat gatacaaaa tgg | 1213 | GAG GAG AAT GAT ACA AAA TGG | LEPGEKPYKCPECGKSFSRSDHL TTHQRTHTGEKPYKCPECGKSFS QRANLRAHQRTHTGEKPYKCPEC GKSFSSPADLTRHQRTHTGEKPY KCPECGKSFSTSGNLVRHQRTHT GEKPYKCPECGKSFSTTGNLTVH QRTHTGEKPYKCPECGKSFSRSD NLVRHQRTHTGEKPYKCPECGKS FSRSDNLVRHQRTHTGEKPTGKK TS | 1762 | $X_1X_2X_3X_4X_5X_6X_7X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}QRANLRAHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}TTGNLTVHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_{25}X_{26}X_{27}X_{28}X_{29}X_{30}$ | 2311 |

TABLE 10-continued

| Column 1 Nucleotide Sequence of Target Site in HNF4α Expression Control Region | Column 2 Column 3 Target sequence with space | Column 3 | Column 4 Amino acid Sequence of Zinc Finger DNA Binding Domain Polypeptides Targeting the Target Site in Column 1 | Column 5 SEQ ID NO. (corresponds to sequences in Columns 2 and 3) | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| aatgataca aaatgtag gtt | AAT GAT ACA AAA TGG TAG GTT | | LEPGEKPYKCPECGKSFSTSGSL VRHQRTHTGEKPYKCPECGKSFS REDNLHTHQRTHTGEKPYKCPEC GKSFSRSDHLTHQRTHTGEKPY KCPECGKSFSQRANLRAHQRTHT GEKPYKCPECGKSFSSPADLTRH QRTHTGEKPYKCPECGKSFSTSG NLVRHQRTHTGEKPYKCPECGKS FSTTGNLTVHQRTHTGEKPTGKK TS | 1214 | $X_1X_2X_3X_4X_5X_6X_7X_8X_9CX_{10}X_{11}CX_{12}X_{13}X_{14}X_{15}X_{16}TSGSLVRHX_{17}X_{18}X_{19}HX_{20}X_{21}X_{22}X_{23}X_{24}X_8X_9CX_{10}X_{11}CX_{12}X_{13}X_{14}X_{15}X_{16}REDNLHTHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}HX_{20}X_{21}X_{22}X_{23}X_{24}X_8X_9CX_{10}X_{11}CX_{12}X_{13}X_{14}X_{15}X_{16}QRANLRAH X_{17}X_{18}X_{19}HX_{20}X_{21}X_{22}X_{23}X_{24}X_8X_9CX_{10}X_{11}CX_{12}X_{13}X_{14}X_{15}X_{16}SPADLT RHX_{17}X_{18}X_{19}HX_{20}X_{21}X_{22}X_{23}X_{24}X_8X_9CX_{10}X_{11}CX_{12}X_{13}X_{14}X_{15}X_{16}TSGN LVRHX_{17}X_{18}X_{19}HX_{20}X_{21}X_{22}X_{23}X_{24}X_8X_9CX_{10}X_{11}CX_{12}X_{13}X_{14}X_{15}X_{16}TT GNLTVHX_{17}X_{18}X_{19}HX_{20}X_{21}X_{22}X_{23}X_{24}X_{25}X_{26}X_{27}X_{28}X_{29}X_{30}$ | 2312 |
| ggtcctaca ggcagcac agg | GGT CCT ACA GGC CAG CAC AGG | | LEPGEKPYKCPECGKSFSRSDHL TNHQRTHTGEKPYKCPECGKSFS SKKALTEHQRTHTGEKPYKCPEC GKSFSRADNLTEHQRTHTGEKPY KCPECGKSFSDPGHLVRHQRTHT GEKPYKCPECGKSFSSPADLTRH QRTHTGEKPYKCPECGKSFSTKN SLTEHQRTHTGEKPYKCPECGKS FSTSGHLVRHQRTHTGEKPTGKK TS | 1215 | $X_1X_2X_3X_4X_5X_6X_7X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRH X_{17}X_{18}X_{19}HX_{20}X_{21}X_{22}X_{23}X_{24}X_8X_9CX_{10}X_{11}CX_{12}X_{13}X_{14}X_{15}X_{16}SPADLT RHX_{17}X_{18}X_{19}HX_{20}X_{21}X_{22}X_{23}X_{24}X_8X_9CX_{10}X_{11}CX_{12}X_{13}X_{14}X_{15}X_{16}TKNS LTEHX_{17}X_{18}X_{19}HX_{20}X_{21}X_{22}X_{23}X_{24}X_8X_9CX_{10}X_{11}CX_{12}X_{13}X_{14}X_{15}X_{16}TS GHLVRHX_{17}X_{18}X_{19}HX_{20}X_{21}X_{22}X_{23}X_{24}X_{25}X_{26}X_{27}X_{28}X_{29}X_{30}$ | 2313 |
| taggttggt cctacaggc cag | TAG GTT GGT CCT ACA GGC CAG | | LEPGEKPYKCPECGKSFSRADNL TEHQRTHTGEKPYKCPECGKSFS DPGHLVRHQRTHTGEKPYKCPEC GKSFSSPADLTRHQRTHTGEKPY KCPECGKSFSTKNSLTEHQRTHT GEKPYKCPECGKSFSTSGHLVRH QRTHTGEKPYKCPECGKSFSTSG SLVRHQRTHTGEKPYKCPECGKS FSREDNLHTHQRTHTGEKPTGKK TS | 1216 | $X_1X_2X_3X_4X_5X_6X_7X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}TKNSLTEH X_{17}X_{18}X_{19}HX_{20}X_{21}X_{22}X_{23}X_{24}X_8X_9CX_{10}X_{11}CX_{12}X_{13}X_{14}X_{15}X_{16}TSGHLV RHX_{17}X_{18}X_{19}HX_{20}X_{21}X_{22}X_{23}X_{24}X_8X_9CX_{10}X_{11}CX_{12}X_{13}X_{14}X_{15}X_{16}TSGS LVRHX_{17}X_{18}X_{19}HX_{20}X_{21}X_{22}X_{23}X_{24}X_8X_9CX_{10}X_{11}CX_{12}X_{13}X_{14}X_{15}X_{16}RE DNLHTHX_{17}X_{18}X_{19}HX_{20}X_{21}X_{22}X_{23}X_{24}X_{25}X_{26}X_{27}X_{28}X_{29}X_{30}$ | 2314 |
| tggtaggtt ggtcctaca ggc | TGG TAG GTT GGT CCT ACA GGC | | LEPGEKPYKCPECGKSFSDPGHL VRHQRTHTGEKPYKCPECGKSFS SPADLTRHQRTHTGEKPYKCPEC GKSFSTKNSLTEHQRTHTGEKPY KCPECGKSFSTSGHLVRHQRTHT GEKPYKCPECGKSFSTSGSLVRH QRTHTGEKPYKCPECGKSFSRED NLHTHQRTHTGEKPYKCPECGKS FSRSDHLTTHQRTHTGEKPTGKK TS | 1217 | $X_1X_2X_3X_4X_5X_6X_7X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGSLV RHX_{17}X_{18}X_{19}HX_{20}X_{21}X_{22}X_{23}X_{24}X_8X_9CX_{10}X_{11}CX_{12}X_{13}X_{14}X_{15}X_{16}REDN LHTHX_{17}X_{18}X_{19}HX_{20}X_{21}X_{22}X_{23}X_{24}X_8X_9CX_{10}X_{11}CX_{12}X_{13}X_{14}X_{15}X_{16}RS DHLTTHX_{17}X_{18}X_{19}HX_{20}X_{21}X_{22}X_{23}X_{24}X_{25}X_{26}X_{27}X_{28}X_{29}X_{30}$ | 2315 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| aaatggtag gttggtcct aca | 1218 | AAA TGG TAG GTT GGT CCT GAC | LEPGEKPYKCPECGKSFSSPADL TRHQRTHTGEKPYKCPECGKSFS TKNSLTEHQRTHTGEKPYKCPEC GKSFSTSGHLVRHQRTHTGEKPY KCPECGKSFSTSGSLVRHQRTHT GEKPYKCPECGKSFSREDNLHTH ARTHTGEKPYKCPECGKSFSRSD HLTTHQRTHTGEKPYKCPECGKS FSQRANLRAHQRTHTGEKPTGKK TS | 1767 | $X_1X_2X_3X_4X_5X_6X_7X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGSLVRH X_{17}X_{18}X_{19}HX_{20}X_{21}X_{22}X_{23}X_{24}X_8X_9CX_{10}X_{11}CX_{12}X_{13}X_{14}X_{15}X_{16}REDNLH THX_{17}X_{18}X_{19}HX_{20}X_{21}X_{22}X_{23}X_{24}X_8X_9CX_{10}X_{11}CX_{12}X_{13}X_{14}X_{15}X_{16}RSDH LTTHX_{17}X_{18}X_{19}HX_{20}X_{21}X_{22}X_{23}X_{24}X_8X_9CX_{10}X_{11}CX_{12}X_{13}X_{14}X_{15}X_{16}QR ANLRAHX_{17}X_{18}X_{19}HX_{20}X_{21}X_{22}X_{23}X_{24}X_{25}X_{26}X_{27}X_{28}X_{29}X_{30}$ | 2316 |
| acaaaatgg taggtggt cct | 1219 | ACA AAA TGG TAG GTT GGT CCT | LEPGEKPYKCPECGKSFSTKNSL TEHQRTHTGEKPYKCPECGKSFS TSGHLVRHQRTHTGEKPYKCPEC GKSFSTSGSLVRHQRTHTGEKPY KCPECGKSFSREDNLHTHQRTHT GEKPYKCPECGKSFSRSDHLTTH QRTHTGEKPYKCPECGKSFSQRA NLRAHQRTHTGEKPYKCPECGKS FSSPADLTRHQRTHTGEKPTGKK TS | 1768 | $X_1X_2X_3X_4X_5X_6X_7X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGSLVRHX_{17}X_{18}X_{19}HX_{20}X_{21}X_{22}X_{23}X_{24}X_8X_9CX_{10}X_{11}CX_{12}X_{13}X_{14}X_{15}X_{16}REDNLHTH X_{17}X_{18}X_{19}HX_{20}X_{21}X_{22}X_{23}X_{24}X_8X_9CX_{10}X_{11}CX_{12}X_{13}X_{14}X_{15}X_{16}RSDHLT THX_{17}X_{18}X_{19}HX_{20}X_{21}X_{22}X_{23}X_{24}X_8X_9CX_{10}X_{11}CX_{12}X_{13}X_{14}X_{15}X_{16}QRAN LRAHX_{17}X_{18}X_{19}HX_{20}X_{21}X_{22}X_{23}X_{24}X_8X_9CX_{10}X_{11}CX_{12}X_{13}X_{14}X_{15}X_{16}SP ADLTRHX_{17}X_{18}X_{19}HX_{20}X_{21}X_{22}X_{23}X_{24}X_{25}X_{26}X_{27}X_{28}X_{29}X_{30}$ | 2317 |
| gatacaaaa tggtaggtt ggt | 1220 | GAT ACA AAA TGG TAG GTT GGT | LEPGEKPYKCPECGKSFSTSGHL VRHQRTHTGEKPYKCPECGKSFS TSGSLVRHQRTHTGEKPYKCPEC GKSFSREDNLHTHQRTHTGEKPY KCPECGKSFSRSDHLTTHQRTHT GEKPYKCPECGKSFSQRANLRAH QRTHTGEKPYKCPECGKSFSSPA DLTRHQRTHTGEKPYKCPECGKS FSTSGNLVRHQRTHTGEKPTGKK TS | 1769 | $X_1X_2X_3X_4X_5X_6X_7X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGSLVRHX_{17}X_{18}X_{19}HX_{20}X_{21}X_{22}X_{23}X_{24}X_8X_9CX_{10}X_{11}CX_{12}X_{13}X_{14}X_{15}X_{16}REDNLHTHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTH X_{17}X_{18}X_{19}HX_{20}X_{21}X_{22}X_{23}X_{24}X_8X_9CX_{10}X_{11}CX_{12}X_{13}X_{14}X_{15}X_{16}QRANLR AHX_{17}X_{18}X_{19}HX_{20}X_{21}X_{22}X_{23}X_{24}X_8X_9CX_{10}X_{11}CX_{12}X_{13}X_{14}X_{15}X_{16}SPAD LTRHX_{17}X_{18}X_{19}HX_{20}X_{21}X_{22}X_{23}X_{24}X_8X_9CX_{10}X_{11}CX_{12}X_{13}X_{14}X_{15}X_{16}TS GNLVRHX_{17}X_{18}X_{19}HX_{20}X_{21}X_{22}X_{23}X_{24}X_{25}X_{26}X_{27}X_{28}X_{29}X_{30}$ | 2318 |
| gttggtcct acaggccag cac | 1221 | GTT GGT CCT ACA GGC CAG CAC | LEPGEKPYKCPECGKSFSSKKAL TEHQRTHTGEKPYKCPECGKSFS RADNLTEHQRTHTGEKPYKCPEC GKSFSDPGHLVRHQRTHTGEKPY KCPECGKSFSPADLTRHQRTHT GEKPYKCPECGKSFSTKNSLTEH QRTHTGEKPYKCPECGKSFSTSG HLVRHQRTHTGEKPYKCPECGKS FSTSGSLVRHQRTHTGEKPTGKK TS | 1770 | $X_1X_2X_3X_4X_5X_6X_7X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRH X_{17}X_{18}X_{19}HX_{20}X_{21}X_{22}X_{23}X_{24}X_8X_9CX_{10}X_{11}CX_{12}X_{13}X_{14}X_{15}X_{16}TKNSLT EHX_{17}X_{18}X_{19}HX_{20}X_{21}X_{22}X_{23}X_{24}X_8X_9CX_{10}X_{11}CX_{12}X_{13}X_{14}X_{15}X_{16}TSGH LVRHX_{17}X_{18}X_{19}HX_{20}X_{21}X_{22}X_{23}X_{24}X_8X_9CX_{10}X_{11}CX_{12}X_{13}X_{14}X_{15}X_{16}TS GSLVRHX_{17}X_{18}X_{19}HX_{20}X_{21}X_{22}X_{23}X_{24}X_{25}X_{26}X_{27}X_{28}X_{29}X_{30}$ | 2319 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gtcctacag gccagcaca ggt | 1222 | GTC CTA CAG GCC AGC ACA GGT | LEPGEKPYKCPECGKSFSTSGHL VRHQRTHTGEKPYKCPECGKSFS SPADLTRHQRTHTGEKPYKCPEC GKSFSERSHLREHQRTHTGEKPY KCPECGKSFSDCRDLARHQRTHT GEKPYKCPECGKSFSRADNLTEH QRTHTGEKPYKCPECGKSFSQNS TLTEHQRTHTGEKPYKCPECGKS FSDPGALVRHQRTHTGEKPTGKK TS | 1771 | $X_1X_2X_3X_4X_5X_6X_7X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}ERSHLREHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}QNSTLTEHX_{17}X_{18}X_{19}HX_{20}X_{21}X_{22}X_{23}X_{24}X_{25}X_{26}X_{27}X_{28}X_{29}X_{16}DPGALVRHX_{17}X_{18}X_{19}HX_{20}X_{21}X_{22}X_{23}X_{24}X_{25}X_{26}X_{27}X_{28}X_{29}X_{30}$ | 2320 |
| caggccagc acaggtgtt gcc | 1223 | CAG GCC AGC ACA GGT GTT GCC | LEPGEKPYKCPECGKSFSDCRDL ARHQRTHTGEKPYKCPECGKSFS TSGSLVRHQRTHTGEKPYKCPEC GKSFSTSGHLVRHQRTHTGEKPY KCPECGKSFSSPADLTRHQRTHT GEKPYKCPECGKSFSERSHLREH QRTHTGEKPYKCPECGKSFSDCR DLARHQRTHTGEKPYKCPECGKS FSRADNLTEHQRTHTGEKPTGKK TS | 1772 | $X_1X_2X_3X_4X_5X_6X_7X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}TSGSLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}ERSHLREHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_{25}X_{26}X_{27}X_{28}X_{29}X_{30}$ | 2321 |
| ctacaggcc agcacaggt gtt | 1224 | CTA CAG GCC AGC ACA GGT GTT | LEPGEKPYKCPECGKSFSTSGSL VRHQRTHTGEKPYKCPECGKSFS TSGHLVRHQRTHTGEKPYKCPEC GKSFSSPADLTRHQRTHTGEKPY KCPECGKSFSERSHLREHQRTHT GEKPYKCPECGKSFSDCRDLARH QRTHTGEKPYKCPECGKSFSRAD NLTEHQRTHTGEKPYKCPECGKS FSQNSTLTEHQRTHTGEKPTGKK TS | 1773 | $X_1X_2X_3X_4X_5X_6X_7X_8X_9CX_{10}X_{11}CX_{12}X_{13}X_{14}X_{15}X_{16}TSGSLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}ERSHLREHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}QNSTLTEHX_{17}X_{18}X_{19}HX_{20}X_{21}X_{22}X_{23}X_{24}X_{25}X_{26}X_{27}X_{28}X_{29}X_{30}$ | 2322 |
| ggtgttgcc aagtgaagc cca | 1225 | GGT GTT GCC AAG TGA AGC CCA | LEPGEKPYKCPECGKSFSTSHSL TEHQRTHTGEKPYKCPECGKSFS ERSHLREHQRTHTGEKPYKCPEC GKSFSQAGHLASHQRTHTGEKPY KCPECGKSFSRKDNLKNHQRTHT GEKPYKCPECGKSFSDCRDLARH QRTHTGEKPYKCPECGKSFSTSG SLVRHQRTHTGEKPYKCPECGKS FSTSGHLVRHQRTHTGEKPTGKK TS | 1774 | $X_1X_2X_3X_4X_5X_6X_7X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}ERSHLREHX_{17}X_{18}X_{19}HX_{20}X_{21}X_{22}X_{23}X_{24}X_8X_9CX_{10}X_{11}CX_{12}X_{13}X_{14}X_{15}X_{16}QAGHLASHX_{17}X_{18}X_{19}HX_{20}X_{21}X_{22}X_{23}X_{24}X_8X_9CX_{10}X_{11}CX_{12}X_{13}X_{14}X_{15}X_{16}RKDNLKNHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}TSGSLVRHX_{17}X_{18}X_{19}HX_{20}X_{21}X_{22}X_{23}X_{24}X_{25}X_{26}X_{27}X_{28}X_{29}X_{16}TSGHLVRHX_{17}X_{18}X_{19}HX_{20}X_{21}X_{22}X_{23}X_{24}X_{25}X_{26}X_{27}X_{28}X_{29}X_{30}$ | 2323 |

TABLE 10-continued

| Column 1 Nucleotide Sequence of Target Site in HNF4α Expression Control Region | Column 2 Column 3 Target sequence with space | Column 3 Target sequence with space | Column 4 Amino acid Sequence of Zinc Finger DNA Binding Domain Polypeptides Targeting the Target Site in Column 1 | Column 5 SEQ ID NO. | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| agcacaggt gttgccaag tga | 1226 | AGC ACA GGT GTT GCC AAG TGA | LEPGEKPYKCPECGKSFSQAGHL ASHQRTHTGEKPYKCPECGKSFS RKDNLKNHQRTHTGEKPYKCPEC GKSFSDCRDLARHQRTHTGEKPY KCPECGKSFSTSGSLVRHQRTHT GEKPYKCPECGKSFSTSGHLVRH QRTHTGEKPYKCPECGKSFSSPA DLTRHQRTHTGEKPYKCPECGKS FSERSHLREHQRTHTGEKPTGKK TS | 1775 | $X_1X_2X_3X_4X_5X_6X_7X_8X_9CX_{10}X_{11}CX_{12}X_{13}X_{14}X_{15}X_{16}QAGHLASHX_{17}X_{18}X_{19}HX_{20}X_{21}X_{22}X_{23}X_{24}X_8X_9CX_{10}CX_{12}X_{13}X_{14}X_{15}X_{16}RKDNLKNHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}TSGSLVRH X_{17}X_{18}X_{19}HX_{20}X_{21}X_{22}X_{23}X_{24}X_8X_9CX_{10}X_{11}CX_{12}X_{13}X_{14}X_{15}X_{16}TSGHLV RHX_{17}X_{18}X_{19}HX_{20}X_{21}X_{22}X_{23}X_{24}X_8X_9CX_{10}X_{11}CX_{12}X_{13}X_{14}X_{15}X_{16}SPAD LTRHX_{17}X_{18}X_{19}HX_{20}X_{21}X_{22}X_{23}X_{24}X_{25}X_{26}X_{27}X_{28}X_{29}X_{30}$ | 2324 |
| acaggtgtt gccaagtga agc | 1227 | ACA GGT GTT GCC AAG TGA AGC | LEPGEKPYKCPECGKSFSERSHL REHQRTHTGEKPYKCPECGKSFS QAGHLASHQRTHTGEKPYKCPEC GKSFSRKDNLKNHQRTHTGEKPY KCPECGKSFSDCRDLARHQRTHT GEKPYKCPECGKSFSTSGSLVRH QRTHTGEKPYKCPECGKSFSTSG HLVRHQRTHTGEKPYKCPECGKS FSSPADLTRHQRTHTGEKPTGKK TS | 1776 | $X_1X_2X_3X_4X_5X_6X_7X_8X_9CX_{10}X_{11}CX_{12}X_{13}X_{14}X_{15}X_{16}ERSHLREHX_{17}X_{18}X_{19}HX_{20}X_{21}X_{22}X_{23}X_{24}X_8X_9CX_{10}X_{11}CX_{12}X_{13}X_{14}X_{15}X_{16}QAGHLASHX_{17}X_{18}X_{19}HX_{20}X_{21}X_{22}X_{23}X_{24}X_8X_9CX_{10}X_{11}CX_{12}X_{13}X_{14}X_{15}X_{16}RKDNLKNHX_{17}X_8X_{19}HX_{20}X_{21}X_{22}X_{23}X_{24}X_8X_9CX_{10}X_{11}CX_{12}X_{13}X_{14}X_{15}X_{16}DCRDLARH X_{17}X_{18}X_{19}HX_{20}X_{21}X_{22}X_{23}X_{24}X_8X_9CX_{10}X_{11}CX_{12}X_{13}X_{14}X_{15}X_{16}TSGSLV RHX_{17}X_{18}X_{19}HX_{20}X_{21}X_{22}X_{23}X_{24}X_8X_9CX_{10}X_{11}CX_{12}X_{13}X_{14}X_{15}X_{16}TSGH LVRHX_{17}X_{18}X_{19}HX_{20}X_{21}X_{22}X_{23}X_{24}X_8X_9CX_{10}X_{11}CX_{12}X_{13}X_{14}X_{15}X_{16}SP ADLTRHX_{17}X_{18}X_{19}HX_{20}X_{21}X_{22}X_{23}X_{24}X_{25}X_{26}X_{27}X_{28}X_{29}X_{30}$ | 2325 |
| gccagcaca ggtgttgcc aag | 1228 | GCC AGC ACA GGT GTT GCC APG | LEPGEKPYKCPECGKSFSRKDNL KNHQRTHTGEKPYKCPECGKSFS DCRDLARHQRTHTGEKPYKCPEC GKSFSTSGSLVRHQRTHTGEKPY KCPECGKSFSTSGHLVRHQRTHT GEKPYKCPECGKSFSSPADLTRH QRTHTGEKPYKCPECGKSFSERS HLREHQRTHTGEKPYKCPECGKS FSDCRDLARHQRTHTGEKPTGKK TS | 1777 | $X_1X_2X_3X_4X_5X_6X_7X_8X_9CX_{10}X_{11}CX_{12}X_{13}X_{14}X_{15}X_{16}RKDNLKNHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}TSGSLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRH X_{17}X_{18}X_{19}HX_{20}X_{21}X_{22}X_{23}X_{24}X_8X_9CX_{10}X_{11}CX_{12}X_{13}X_{14}X_{15}X_{16}SPADLT RHX_{17}X_{18}X_{19}HX_{20}X_{21}X_{22}X_{23}X_{24}X_8X_9CX_{10}X_{11}CX_{12}X_{13}X_{14}X_{15}X_{16}ERSH LREHX_{17}X_{18}X_{19}HX_{20}X_{21}X_{22}X_{23}X_{24}X_8X_9CX_{10}X_{11}CX_{12}X_{13}X_{14}X_{15}X_{16}DC RDLARHX_{17}X_{18}X_{19}HX_{20}X_{21}X_{22}X_{23}X_{24}X_{25}X_{26}X_{27}X_{28}X_{29}X_{30}$ | 2326 |
| aggcacagt gatccaagg cat | 1229 | AGG CAC AGT GAT GAT CAC AGG CAT | LEPGEKPYKCPECGKSFSTSGNL TEHQRTHTGEKPYKCPECGKSFS RSDHLTNHQRTHTGEKPYKCPEC GKSFSSKKALTEHQRTHTGEKPY KCPECGKSFSTSGNLVRHQRTHT GEKPYKCPECGKSFSHRTTLTNH QRTHTGEKPYKCPECGKSFSSKK ALTEHQRTHTGEKPYKCPECGKS FSRSDHLTNHQRTHTGEKPTGKK TS | 1778 | $X_1X_2X_3X_4X_5X_6X_7X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLVRH X_{17}X_{18}X_{19}HX_{20}X_{21}X_{22}X_{23}X_{24}X_8X_9CX_{10}X_{11}CX_{12}X_{13}X_{14}X_{15}X_{16}HRTTLT NHX_{17}X_{18}X_{19}HX_{20}X_{21}X_{22}X_{23}X_{24}X_8X_9CX_{10}X_{11}CX_{12}X_{13}X_{14}X_{15}X_{16}SKKA LTEHX_{17}X_{18}X_{19}HX_{20}X_{21}X_{22}X_{23}X_{24}X_8X_9CX_{10}X_{11}CX_{12}X_{13}X_{14}X_{15}X_{16}RS DHLTNHX_{17}X_{18}X_{19}HX_{20}X_{21}X_{22}X_{23}X_{24}X_{25}X_{26}X_{27}X_{28}X_{29}X_{30}$ | 2327 |

TABLE 10-continued

| Column 1 Nucleotide Sequence of Target Site in HNF4α Expression Control Region | Column 3 Target sequence with space | Column 4 Amino acid Sequence of Zinc Finger DNA Binding Domain Polypeptides Targeting the Target Site in Column 1 | Column 2 SEQ ID NO. (corresponds to sequences in Columns 1 and 3) | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| ccaagtgaa gcccatgtg ccc | CCA AGT GAA GCC CAT gtg CCC | LEPGEKPYKCPECGKSFSSKKHL AEHQRTHTGEKPYKCPECGKSFS RSDELVRHQRTHTGEKPYKCPEC GKSFSTSGNLTEHQRTHTGEKPY KCPECGKSFSDCRDLARHQRTHT GEKPYKCPECGKSFSQSSNLVRH QRTHTGEKPYKCPECGKSFSHRT TLTNHQRTHTGEKPYKCPECGKS FSTSHSLTEHQRTHTGEKPTGKK TS | 1230 | 1779 | $X_1X_2X_3X_4X_5X_6X_7X_8X_9CX_{10}X_{11}CX_{12}X_{13}X_{14}X_{15}X_{16}$SKKHLAEHX$_{17}X_{18}X_{19}$ HX$_{20}X_{21}X_{22}X_{23}X_{24}X_8X_9CX_{10}X_{11}CX_{12}X_{13}X_{14}X_{15}X_{16}$RSDELVRHX$_{17}X_{18}$ X$_{19}$HX$_{20}X_{21}X_{22}X_{23}X_{24}X_8X_9CX_{10}X_{11}CX_{12}X_{13}X_{14}X_{15}X_{16}$TSGNLTEHX$_{17}$ X$_{18}X_{19}$HX$_{20}X_{21}X_{22}X_{23}X_{24}X_8X_9CX_{10}X_{11}CX_{12}X_{13}X_{14}X_{15}X_{16}$DCRDLARH X$_{17}X_{18}X_{19}$HX$_{20}X_{21}X_{22}X_{23}X_{24}X_8X_9CX_{10}X_{11}CX_{12}X_{13}X_{14}X_{15}X_{16}$QSSNLV RHX$_{17}X_{18}X_{19}$HX$_{20}X_{21}X_{22}X_{23}X_{24}X_8X_9CX_{10}X_{11}CX_{12}X_{13}X_{14}X_{15}X_{16}$HRTT LTNHX$_{17}X_{18}X_{19}$HX$_{20}X_{21}X_{22}X_{23}X_{24}X_8X_9CX_{10}X_{11}CX_{12}X_{13}X_{14}X_{15}X_{16}$TS HSLTEHX$_{17}X_{18}X_{19}$HX$_{20}X_{21}X_{22}X_{23}X_{24}X_{25}X_{26}X_{27}X_{28}X_{29}X_{30}$ | 2328 |
| gaagcccat gtgcccagg cac | GAA GCC CAT gtg CCC AGG CAC | LEPGEKPYKCPECGKSFSSKKAL TEHQRTHTGEKPYKCPECGKSFS RSDHLTNHQRTHTGEKPYKCPEC GKSFSSKKHLAEHQRTHTGEKPY KCPECGKSFSRSDELVRHQRTHT GEKPYKCPECGKSFSTSGNLTEH QRTHTGEKPYKCPECGKSFSDCR DLARHQRTHTGEKPYKCPECGKS FSQSSNLVRHQRTHTGEKPTGKK TS | 1231 | 1780 | $X_1X_2X_3X_4X_5X_6X_7X_8X_9CX_{10}X_{11}CX_{12}X_{13}X_{14}X_{15}X_{16}$SKKALTEHX$_{17}X_{18}X_{19}$ HX$_{20}X_{21}X_{22}X_{23}X_{24}X_8X_9CX_{10}X_{11}CX_{12}X_{13}X_{14}X_{15}X_{16}$RSDHLTNHX$_{17}X_{18}$ X$_{19}$HX$_{20}X_{21}X_{22}X_{23}X_{24}X_8X_9CX_{10}X_{11}CX_{12}X_{13}X_{14}X_{15}X_{16}$SKKHLAEHX$_{17}$ X$_{18}X_{19}$HX$_{20}X_{21}X_{22}X_{23}X_{24}X_8X_9CX_{10}X_{11}CX_{12}X_{13}X_{14}X_{15}X_{16}$RSDELVRH X$_{17}X_{18}X_{19}$HX$_{20}X_{21}X_{22}X_{23}X_{24}X_8X_9CX_{10}X_{11}CX_{12}X_{13}X_{14}X_{15}X_{16}$TSGNLT EHX$_{17}X_{18}X_{19}$HX$_{20}X_{21}X_{22}X_{23}X_{24}X_8X_9CX_{10}X_{11}CX_{12}X_{13}X_{14}X_{15}X_{16}$DCRD LARHX$_{17}X_{18}X_{19}$HX$_{20}X_{21}X_{22}X_{23}X_{24}X_8X_9CX_{10}X_{11}CX_{12}X_{13}X_{14}X_{15}X_{16}$QS SNLVRHX$_{17}X_{18}X_{19}$HX$_{20}X_{21}X_{22}X_{23}X_{24}X_{25}X_{26}X_{27}X_{28}X_{29}X_{30}$ | 2329 |
| agtgaagcc catgtgccc agg | AGT GAA GCC CAT gtg CCC AGG | LEPGEKPYKCPECGKSFSRSDHL TNHQRTHTGEKPYKCPECGKSFS SKKHLAEHQRTHTGEKPYKCPEC GKSFSRSDELVRHQRTHTGEKPY KCPECGKSFSTSGNLTEHQRTHT GEKPYKCPECGKSFSDCRDLARH QRTHTGEKPYKCPECGKSFSQSS NLVRHQRTHTGEKPYKCPECGKS FSHRTTLTNHQRTHTGEKPTGKK TS | 1232 | 1781 | $X_1X_2X_3X_4X_5X_6X_7X_8X_9CX_{10}X_{11}CX_{12}X_{13}X_{14}X_{15}X_{16}$RSDHLTNHX$_{17}X_{18}X_{19}$ HX$_{20}X_{21}X_{22}X_{23}X_{24}X_8X_9CX_{10}X_{11}CX_{12}X_{13}X_{14}X_{15}X_{16}$SKKHLAEHX$_{17}X_{18}$ X$_{19}$HX$_{20}X_{21}X_{22}X_{23}X_{24}X_8X_9CX_{10}X_{11}CX_{12}X_{13}X_{14}X_{15}X_{16}$RSDELVRHX$_{17}$ X$_{18}X_{19}$HX$_{20}X_{21}X_{22}X_{23}X_{24}X_8X_9CX_{10}X_{11}CX_{12}X_{13}X_{14}X_{15}X_{16}$TSGNLTEH X$_{17}X_{18}X_{19}$HX$_{20}X_{21}X_{22}X_{23}X_{24}X_8X_9CX_{10}X_{11}CX_{12}X_{13}X_{14}X_{15}X_{16}$DCRDLA RHX$_{17}X_{18}X_{19}$HX$_{20}X_{21}X_{22}X_{23}X_{24}X_8X_9CX_{10}X_{11}CX_{12}X_{13}X_{14}X_{15}X_{16}$QSSN LVRHX$_{17}X_{18}X_{19}$HX$_{20}X_{21}X_{22}X_{23}X_{24}X_8X_9CX_{10}X_{11}CX_{12}X_{13}X_{14}X_{15}X_{16}$HR TTLTNHX$_{17}X_{18}X_{19}$HX$_{20}X_{21}X_{22}X_{23}X_{24}X_{25}X_{26}X_{27}X_{28}X_{29}X_{30}$ | 2330 |
| gtgcccagg cacagtgat cac | gtg CCC AGG CAC AGT GAT CAC | LEPGEKPYKCPECGKSFSSKKAL TEHQRTHTGEKPYKCPECGKSFS TSGNLVRHQRTHTGEKPYKCPEC GKSFSHRTTLTNHQRTHTGEKPY KCPECGKSFSSKKALTEHQRTHT GEKPYKCPECGKSFSRSDHLTNH QRTHTGEKPYKCPECGKSFSKKH HLAEHQRTHTGEKPYKCPECGKS FSRSDELVRHQRTHTGEKPTGKK TS | 1233 | 1782 | $X_1X_2X_3X_4X_5X_6X_7X_8X_9CX_{10}X_{11}CX_{12}X_{13}X_{14}X_{15}X_{16}$SKKALTEHX$_{17}X_{18}X_{19}$ HX$_{20}X_{21}X_{22}X_{23}X_{24}X_8X_9CX_{10}X_{11}CX_{12}X_{13}X_{14}X_{15}X_{16}$TSGNLVRHX$_{17}X_{18}$ X$_{19}$HX$_{20}X_{21}X_{22}X_{23}X_{24}X_8X_9CX_{10}X_{11}CX_{12}X_{13}X_{14}X_{15}X_{16}$HRTTLTNHX$_{17}$ X$_{18}X_{19}$HX$_{20}X_{21}X_{22}X_{23}X_{24}X_8X_9CX_{10}X_{11}CX_{12}X_{13}X_{14}X_{15}X_{16}$SKKALTEH X$_{17}X_{18}X_{19}$HX$_{20}X_{21}X_{22}X_{23}X_{24}X_8X_9CX_{10}X_{11}CX_{12}X_{13}X_{14}X_{15}X_{16}$RSDHLT NHX$_{17}X_{18}X_{19}$HX$_{20}X_{21}X_{22}X_{23}X_{24}X_8X_9CX_{10}X_{11}CX_{12}X_{13}X_{14}X_{15}X_{16}$SKKH LAEHX$_{17}X_{18}X_{19}$HX$_{20}X_{21}X_{22}X_{23}X_{24}X_8X_9CX_{10}X_{11}CX_{12}X_{13}X_{14}X_{15}X_{16}$RS DELVRHX$_{17}X_{18}X_{19}$HX$_{20}X_{21}X_{22}X_{23}X_{24}X_{25}X_{26}X_{27}X_{28}X_{29}X_{30}$ | 2331 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gcccatgtg cccaggcac agt | 1234 | GCC CAT gtg CCC AGG CAC AGT | LEPGEKPYKCPECGKSFSHRTTL TNHQRTHTGEKPYKCPECGKSFS SKKALTEHQRTHTGEKPYKCPEC GKSFSRSDHLTNHQRTHTGEKPY KCPECGKSFSSKKHLAEHQRTHT GEKPYKCPECGKSFSRSDELVRH QRTHTGEKPYKCPECGKSFSTSG NLTEHQRTHTGEKPYKCPECGKS FSDCRDLARHQRTHTGEKPTGKK TS | 1783 | $X_1X_2X_3X_4X_5X_6X_7X_8X_9CX_{10}X_{11}CX_{12}X_{13}X_{14}X_{15}X_{16}HRTTLTNHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_{25}X_{26}X_7X_{28}X_{29}X_{30}$ | 2332 |
| catgtgccc aggcacagt gat | 1235 | CAT gtg CCC AGG CAC AGT GAT | LEPGEKPYKCPECGKSFSTSGNL VRHQRTHTGEKPYKCPECGKSFS HRTTLTNHQRTHTGEKPYKCPEC GKSFSSKKALTEHQRTHTGEKPY KCPECGKSFSRSDHLTNHQRTHT GEKPYKCPECGKSFSSKKHLAEH QRTHTGEKPYKCPECGKSFSRSD ELVRHQRTHTGEKPYKCPECGKS FSTSGNLTEHQRTHTGEKPTGKK TS | 1784 | $X_1X_2X_3X_4X_5X_6X_7X_8X_9CX_{10}X_{11}CX_{12}X_{13}X_{14}X_{15}X_{16}TSGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}HRTTLTNHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_{25}X_{26}X_7X_{28}X_{29}X_{30}$ | 2333 |
| cccaggcac agtgatcac agg | 1236 | CCC AGG CAC AGT GAT CAC AGG | LEPGEKPYKCPECGKSFSRSDHL TNHQRTHTGEKPYKCPECGKSFS SKKALTEHQRTHTGEKPYKCPEC GKSFSTSGNLVRHQRTHTGEKPY KCPECGKSFSHRTTLTNHQRTHT GEKPYKCPECGKSFSSKKALTEH QRTHTGEKPYKCPECGKSFSRSD HLTNHQRTHTGEKPYKCPECGKS ESSKKHLAEHQRTHTGEKPTGKK TS | 1785 | $X_1X_2X_3X_4X_5X_6X_7X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}HRTTLTNHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_{25}X_{26}X_7X_{28}X_{29}X_{30}$ | 2334 |
| gggaggcct gcaaggcc aat | 1237 | ggg AGG CCT GCA AGG GCC AAT | LEPGEKPYKCPECGKSFSTTGNL TVHQRTHTGEKPYKCPECGKSFS DCRDLARHQRTHTGEKPYKCPEC GKSFSRSDHLTNHQRTHTGEKPY KCPECGKSFSQSGDLRRHQRTHT GEKPYKCPECGKSFSTKNSLTEH QRTHTGEKPYKCPECGKSFSRSD HLTNHQRTHTGEKPYKCPECGKS FSRSDKLVRHQRTHTGEKPTGKK TS | 1786 | $X_1X_2X_3X_4X_5X_6X_7X_8X_9CX_{10}X_{11}CX_{12}X_{13}X_{14}X_{15}X_{16}TTGNLTVHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_{25}X_{26}X_{27}X_{28}X_{29}X_{30}$ | 2335 |

TABLE 10-continued

| Column 1 Nucleotide Sequence of Target Site in HNF4α Expression Control Region | Column 3 Target sequence with space | Column 2 SEQ ID NO. (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gaagggagg cctgcaagg gcc | GAA ggg AGG CCT GCA AGG GCC | 1238 | LEPGEKPYKCPECGKSFSDCRDL ARHQRTHTGEKPYKCPECGKSFS RSDHLTNHQRTHTGEKPYKCPEC GKSFSQSGDLRRHQRTHTGEKPY KCPECGKSFSTKNSLTEHQRTHT GEKPYKCPECGKSFSRSDHLTNH QRTHTGEKPYKCPECGKSFSRSD KLVRHQRTHTGEKPYKCPECGKS FSQSSNLVRHQRTHTGEKPTGKK TS | 1787 | $X_1X_2X_3X_4X_5X_6X_7X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSSNLVRHX_{17}X_{18}X_{19}HX_{20}X_{21}X_{22}X_{23}X_{24}X_{25}X_{26}X_{27}X_{28}X_{29}X_{30}$ | 2336 |
| acaggcatt ctgggtgaa ggg | ACA GGC ATT CTG GGT GAA GGG | 1239 | LEPGEKPYKCPECGKSFSRSDKL VRHQRTHTGEKPYKCPECGKSFS QSSNLVRHQRTHTGEKPYKCPEC GKSFSTSGHLVRHQRTHTGEKPY KCPECGKSFSRNDALTEHQRTHT GEKPYKCPECGKSFSHKNALQNH QRTHTGEKPYKCPECGKSFSDPG HLVRHQRTHTGEKPYKCPECGKS FSSPADLTRHQRTHTGEKPTGKK TS | 1788 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSSNLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}HKNALQNHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_{25}X_{26}X_{27}X_{28}X_{29}X_{30}$ | 2337 |
| ctggtgaa gggaggcct gca | CTG GGT GAA ggg AGG CCT GCA | 1240 | LEPGEKPYKCPECGKSFSQSGDL RRHQRTHTGEKPYKCPECGKSIS TKNSLTEHQRTHTGEKPYKCPEC GKSFSRSDHLTNHQRTHTGEKPY KCPECGKSFSRSDKLVRHQRTHT GEKPYKCPECGKSFSQSSNLVRH QRTHTGEKPYKCPECGKSFSTSG HLVRHQRTHTGEKPYKCPECGKS FSRNDALTEHQRTHTGEKPTGKK TS | 1789 | $X_1X_2X_3X_4X_5X_6X_7X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSSNLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_{25}X_{26}X_{27}X_{28}X_{29}X_{30}$ | 2338 |
| atttcgggt gaaggagg cct | ATT CTG GGT GAA ggg AGG CCT | 1241 | LEPGEKPYKCPECGKSFSTKNSL TEHQRTHTGEKPYKCPECGKSFS RSDHLTNHQRTHTGEKPYKCPEC GKSFSRSDKLVRHQRTHTGEKPY KCPECGKSFSQSSNLVRHQRTHT GEKPYKCPECGKSFSTSGHLVRH QRTHTGEKPYKCPECGKSFSRND ALTEHQRTHTGEKPYKCPECGKS FSHKNALQNHQRTHTGEKPTGKK TS | 1790 | $X_1X_2X_3X_4X_5X_6X_7X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSSNLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}HKNALQNHX_{17}X_{18}X_{19}HX_{20}X_{21}X_{22}X_{23}X_{24}X_{25}X_{26}X_{27}X_{28}X_{29}X_{30}$ | 2339 |

TABLE 10-continued

| Column 1 Nucleotide Sequence of Target Site in HNF4α Expression Control Region | Column 3 Target sequence with space | Column 2 SEQ ID NO. (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| ggcattctg ggtgaaggg agg | GGC ATT CTG GGT GAA GGG AGG | 1242 | LEPGEKPYKCPECGKSFSRSDHL TNHQRTHTGEKPYKCPECGKSFS RSDKLVRHQRTHTGEKPYKCPEC GKSFSQSSNLVRHQRTHTGEKPY KCPECGKSFSTSGHLVRHQRTHT GEKPYKCPECGKSFSRNDALTEH QRTHTGEKPYKCPECGKSFSHKN ALQNHQRTHTGEKPYKCPECGKS FSDPGHLVRHQRTHTGEKPTGKK TS | 1791 | $X_1X_2X_3X_4X_5X_6X_7X_8X_9CX_{10}X_{11}CX_{12}X_{13}X_{14}X_{15}X_{16}$RSDHLTNH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$RSDKLVRH$X_{17}X_{18}$ $X_{19}HX_{20}X_{21}X_{22}X_{23}X_{24}X_8X_9CX_{10}X_{11}CX_{12}X_{13}X_{14}X_{15}X_{16}$QSSNLVRH$X_{17}$ $X_{18}X_{19}HX_{20}X_{21}X_{22}X_{23}X_{24}X_8X_9CX_{10}X_{11}CX_{12}X_{13}X_{14}X_{15}X_{16}$TSGHLVRH $X_{17}X_{18}X_{19}HX_{20}X_{21}X_{22}X_{23}X_{24}X_8X_9CX_{10}X_{11}CX_{12}X_{13}X_{14}X_{15}X_{16}$RNDALT EH$X_{17}X_{18}X_{19}HX_{20}X_{21}X_{22}X_{23}X_{24}X_8X_9CX_{10}X_{11}CX_{12}X_{13}X_{14}X_{15}X_{16}$HKNA LQNH$X_{17}X_{18}X_{19}HX_{20}X_{21}X_{22}X_{23}X_{24}X_8X_9CX_{10}X_{11}CX_{12}XEX_{14}X_{15}X_{16}$DP GHLVRH$X_{17}X_{18}X_{19}HX_{20}X_{21}X_{22}X_{23}X_{24}X_{25}X_{26}X_{27}X_{28}X_{29}X_{30}$ | 2340 |
| ggtgaaggg aggcctgca agg | GGT GAA ggg AGG CCT GCA AGG | 1243 | LEPGEKPYKCPECGKSFSRSDHL TNHQRTHTGEKPYKCPECGKSFS QSGDLRRHQRTHTGEKPYKCPEC GKSFSTKNSLTEHQRTHTGEKPY KCPECGKSFSRSDHLTNHQRTHT GEKPYKCPECGKSFSRSDKLVRH QRTHTGEKPYKCPECGKSFSQSS NLVRHQRTHTGEKPYKCPECGKS FSTSGHLVRHQRTHTGEKPTGKK TS | 1792 | $X_1X_2X_3X_4X_5X_6X_7X_8X_9CX_{10}X_{11}CX_{12}X_{13}X_{14}X_{15}X_{16}$RSDHLTNH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$QSGDLRRH$X_{17}X_{18}$ $X_{19}HX_{20}X_{21}X_{22}X_{23}X_{24}X_8X_9CX_{10}X_{11}CX_{12}X_{13}X_{14}X_{15}X_{16}$TKNSLTEH$X_{17}$ $X_{18}X_{19}HX_{20}X_{21}X_{22}X_{23}X_{24}X_8X_9CX_{10}X_{11}CX_{12}X_{13}X_{14}X_{15}X_{16}$RSDHLTNH $X_{17}X_{18}X_{19}HX_{20}X_{21}X_{22}X_{23}X_{24}X_8X_9CX_{10}X_{11}CX_{12}X_{13}X_{14}X_{15}X_{16}$RSDKLV RH$X_{17}X_{18}X_{19}HX_{20}X_{21}X_{22}X_{23}X_{24}X_8X_9CX_{10}X_{11}CX_{12}X_{13}X_{14}X_{15}X_{16}$QSSN LVRH$X_{17}X_{18}X_{19}HX_{20}X_{21}X_{22}X_{23}X_{24}X_8X_9CX_{10}X_{11}CX_{12}X_{13}X_{14}X_{15}X_{16}$TS GHLVRH$X_{17}X_{18}X_{19}HX_{20}X_{21}X_{22}X_{23}X_{24}X_{25}X_{26}X_{27}X_{28}X_{29}X_{30}$ | 2341 |
| ggagcctg caaggcca att | GGA GGC CTG CAA ggg CCA ATT | 1244 | LEPGEKPYKCPECGKSFSHKNAL QNHQRTHTGEKPYKCPECGKSFS TSHSLTEHQRTHTGEKPYKCPEC GKSFSRSDKLVRHQRTHTGEKPY KCPECGKSFSQSGNLTEHQRTHT GEKPYKCPECGKSFSRNDALTEH QRTHTGEKPYKCPECGKSFSDPG HLVRHQRTHTGEKPYKCPECGKS FSQRAHLERHQRTHTGEKPTGKK TS | 1793 | $X_1X_2X_3X_4X_5X_6X_7X_8X_9CX_{10}X_{11}CX_{12}X_{13}X_{14}X_{15}X_{16}$HKNALQNH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$TSHSLTEH$X_{17}X_{18}$ $X_{19}HX_{20}X_{21}X_{22}X_{23}X_{24}X_8X_9CX_{10}X_{11}CX_{12}X_{13}X_{14}X_{15}X_{16}$RSDKLVRH$X_{17}$ $X_{18}X_{19}HX_{20}X_{21}X_{22}X_{23}X_{24}X_8X_9CX_{10}X_{11}CX_{12}X_{13}X_{14}X_{15}X_{16}$QSGNLTEH $X_{17}X_{18}X_{19}HX_{20}X_{21}X_{22}X_{23}X_{24}X_8X_9CX_{10}X_{11}CX_{12}X_{13}X_{14}X_{15}X_{16}$RNDALT EH$X_{17}X_{18}X_{19}HX_{20}X_{21}X_{22}X_{23}X_{24}X_8X_9CX_{10}X_{11}CX_{12}X_{13}X_{14}X_{15}X_{16}$DPGH LVRH$X_{17}X_{18}X_{19}HX_{20}X_{21}X_{22}X_{23}X_{24}X_8X_9CX_{10}X_{11}CX_{12}X_{13}X_{14}X_{15}X_{16}$QR AHLERH$X_{17}X_{18}X_{19}HX_{20}X_{21}X_{22}X_{23}X_{24}X_{25}X_{26}X_{27}X_{28}X_{29}X_{30}$ | 2342 |
| gtgaaggga ggcctgcaa ggg | gtg AAG GGA GGC CTG CAA GGG | 1245 | LEPGEKPYKCPECGKSFSRSDKL VRHQRTHTGEKPYKCPECGKSFS QSGNLTEHQRTHTGEKPYKCPEC GKSFSRNDALTEHQRTHTGEKPY KCPECGKSFSDPGHLVRHQRTHT GEKPYKCPECGKSFSQRAHLERH QRTHTGEKPYKCPECGKSFSRKD NLKNHQRTHTGEKPYKCPECGKS FSRSDELVRHQRTHTGEKPTGKK TS | 1794 | $X_1X_2X_3X_4X_5X_6X_7X_8X_9CX_{10}X_{11}CX_{12}X_{13}X_{14}X_{15}X_{16}$RSDKLVRH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$QSGNLTEH$X_{17}X_{18}$ $X_{19}HX_{20}X_{21}X_{22}X_{23}X_{24}X_8X_9CX_{10}X_{11}CX_{12}X_{13}X_{14}X_{15}X_{16}$RNDALTEH$X_{17}$ $X_{18}X_{19}HX_{20}X_{21}X_{22}X_{23}X_{24}X_8X_9CX_{10}X_{11}CX_{12}X_{13}X_{14}X_{15}X_{16}$DPGHLVRH $X_{17}X_{18}X_{19}HX_{20}X_{21}X_{22}X_{23}X_{24}X_8X_9CX_{10}X_{11}CX_{12}X_{13}X_{14}X_{15}X_{16}$QRAHLE RH$X_{17}X_{18}X_{19}HX_{20}X_{21}X_{22}X_{23}X_{24}X_8X_9CX_{10}X_{11}CX_{12}X_{13}X_{14}X_{15}X_{16}$RKDN LKNH$X_{17}X_{18}X_{19}HX_{20}X_{21}X_{22}X_{23}X_{24}X_8X_9CX_{10}X_{11}CX_{12}X_{13}X_{14}X_{15}X_{16}$RS DELVRH$X_{17}X_{18}X_{19}HX_{20}X_{21}X_{22}X_{23}X_{24}X_{25}X_{26}X_{27}X_{28}X_{29}X_{30}$ | 2343 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| tgggtgaag ggaggcctg caa | 1246 | TGG gtg AAG GGA GGC CTG CAA | LEPGEKPYKCPECGKSFSQSGNL TEHQRTHTGEKPYKCPECGKSFS RNDALTEHQRTHTGEKPYKCPEC GKSFSDPGHLVRHQRTHTGEKPY KCPECGKSFSQRAHLERHQRTHT GEKPYKCPECGKSFSRKDNLKNH QRTHTGEKPYKCPECGKSFSRSD ELVRHQRTHTGEKPYKCPECGKS FSRSDHLTTHQRTHTGEKPTGKK TS | 1795 | $X_1X_2X_3X_4X_5X_6X_7X_8X_9CX_{10}X_{11}CX_{12}X_{13}X_{14}X_{15}X_{16}QSGNLTEHX_{17}X_{18}X_{19}$ $HX_{20}X_{21}X_{22}X_{23}X_{24}X_8X_9CX_{10}X_{11}CX_{12}X_{13}X_{14}X_{15}X_{16}RNDALTEHX_{17}X_{18}$ $X_{19}HX_{20}X_{21}X_{22}X_{23}X_{24}X_8X_9CX_{10}X_{11}CX_{12}X_{13}X_{14}X_{15}X_{16}DPGHLVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}QRAHLERH$ $X_{17}X_{18}X_{19}HX_{20}X_{21}X_{22}X_{23}X_{24}X_8X_9CX_{10}X_{11}CX_{12}X_{13}X_{14}X_{15}X_{16}RKDNLK$ $NHX_{17}X_{18}X_{19}HX_{20}X_{21}X_{22}X_{23}X_{24}X_8X_9CX_{10}X_{11}CX_{12}X_{13}X_{14}X_{15}X_{16}RSDE$ $LVRHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DHLTTHX_{17}X_{18}X_{19}HX_{20}X_{21}X_{22}X_{23}X_{24}X_{25}X_{26}X_{27}X_{28}X_{29}X_{30}$ | 2344 |
| aagggaggc ctgcaaggg cca | 1247 | AAG GGA GGC CTG CAA ggg CCA | LEPGEKPYKCPECGKSFSTSHSL TEHQRTHTGEKPYKCPECGKSFS RSDKLVRHQRTHTGEKPYKCPEC GKSFSQSGNLTEHQRTHTGEKPY KCPECGKSFSRNDALTEHQRTHT GEKPYKCPECGKSFSDPGHLVRH QRTHTGEKPYKCPECGKSFSQRA HLERHQRTHTGEKPYKCPECGKS FSRKDNLKNHQRTHTGEKPTGKK TS | 1796 | $X_1X_2X_3X_4X_5X_6X_7X_8X_9CX_{10}X_{11}CX_{12}X_{13}X_{14}X_{15}X_{16}TSHSLTEHX_{17}X_{18}X_{19}$ $HX_{20}X_{21}X_{22}X_{23}X_{24}X_8X_9CX_{10}X_{11}CX_{12}X_{13}X_{14}X_{15}X_{16}RSDKLVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}QSGNLTEHX_{17}$ $X_{18}X_{19}HX_{20}X_{21}X_{22}X_{23}X_{24}X_8X_9CX_{10}X_{11}CX_{12}X_{13}X_{14}X_{15}X_{16}RNDALTEH$ $X_{17}X_{18}X_{19}HX_{20}X_{21}X_{22}X_{23}X_{24}X_8X_9CX_{10}X_{11}CX_{12}X_{13}X_{14}X_{15}X_{16}DPGHLV$ $RHX_{17}X_{18}X_{19}HX_{20}X_{21}X_{22}X_{23}X_{24}X_8X_9CX_{10}X_{11}CX_{12}X_{13}X_{14}X_{15}X_{16}QRAH$ $LERHX_{17}X_{18}X_{19}HX_{20}X_{21}X_{22}X_{23}X_{24}X_8X_9CX_{10}X_{11}CX_{12}X_{13}X_{14}X_{15}X_{16}RK$ $DNLKNHX_{17}X_{18}X_{19}HX_{20}X_{21}X_{22}X_{23}X_{24}X_{25}X_{26}X_{27}X_{28}X_{29}X_{30}$ | 2345 |
| actgtgcct gggcacatg ggc | 1248 | ACT gtg CCT ggg CAC ATG GGC | LEPGEKPYKCPECGKSFSDPGHL VRHQRTHTGEKPYKCPECGKSFS RRDELNVHQRTHTGEKPYKCPEC GKSFSSKKALTEHQRTHTGEKPY KCPECGKSFSRSDKLVRHQRTHT GEKPYKCPECGKSFSTKNSLTEH QRTHTGEKPYKCPECGKSFSRSD ELVRHQRTHTGEKPYKCPECGKS FSTHLDLIRHQRTHTGEKPTGKK TS | 1797 | $X_1X_2X_3X_4X_5X_6X_7X_8X_9CX_{10}X_{11}CX_{12}X_{13}X_{14}X_{15}X_{16}DPGHLVRHX_{17}X_{18}X_{19}$ $HX_{20}X_{21}X_{22}X_{23}X_{24}X_8X_9CX_{10}X_{11}CX_{12}X_{13}X_{14}X_{15}X_{16}RRDELNVHX_{17}X_{18}$ $X_{19}HX_{20}X_{21}X_{22}X_{23}X_{24}X_8X_9CX_{10}X_{11}CX_{12}X_{13}X_{14}X_{15}X_{16}SKKALTEHX_{17}$ $X_{18}X_{19}HX_{20}X_{21}X_{22}X_{23}X_{24}X_8X_9CX_{10}X_{11}CX_{12}X_{13}X_{14}X_{15}X_{16}RSDKLVRH$ $X_{17}X_{18}X_{19}HX_{20}X_{21}X_{22}X_{23}X_{24}X_8X_9CX_{10}X_{11}CX_{12}X_{13}X_{14}X_{15}X_{16}TKNSLT$ $EHX_{17}X_{18}X_{19}HX_{20}X_{21}X_{22}X_{23}X_{24}X_8X_9CX_{10}X_{11}CX_{12}X_{13}X_{14}X_{15}X_{16}RSDE$ $LVRHX_{17}X_{18}X_{19}HX_{20}X_{21}X_{22}X_{23}X_{24}X_8X_9CX_{10}X_{11}CX_{12}X_{13}X_{14}X_{15}X_{16}TH$ $LDLIRHX_{17}X_{18}X_{19}HX_{20}X_{21}X_{22}X_{23}X_{24}X_{25}X_{26}X_{27}X_{28}X_{29}X_{30}$ | 2346 |
| gcctggca catggcctt cac | 1249 | GCC TGG CAT GCA ggg CTT CAC | LEPGEKPYKCPECGKSFSSKKAL TEHQRTHTGEKPYKCPECGKSFS TTGALTEHQRTHTGEKPYKCPEC GKSFSRSDKLVRHQRTHTGEKPY KCPECGKSFSTSGNLTEHQRTHT GEKPYKCPECGKSFSQSGDLRRH QRTHTGEKPYKCPECGKSFSRSD HLTTHQRTHTGEKPYKCPECGKS FSDCRDLARHQRTHTGEKPTGKK TS | 1798 | $X_1X_2X_3X_4X_5X_6X_7X_8X_9CX_{10}X_{11}CX_{12}X_{13}X_{14}X_{15}X_{16}SKKALTEHX_{17}X_{18}X_{19}$ $HX_{20}X_{21}X_{22}X_{23}X_{24}X_8X_9CX_{10}X_{11}CX_{12}X_{13}X_{14}X_{15}X_{16}TTGALTEHX_{17}X_{18}$ $X_{19}HX_{20}X_{21}X_{22}X_{23}X_{24}X_8X_9CX_{10}X_{11}CX_{12}X_{13}X_{14}X_{15}X_{16}RSDKLVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}TSGNLTEH$ $X_{17}X_{18}X_{19}HX_{20}X_{21}X_{22}X_{23}X_{24}X_8X_9CX_{10}X_{11}CX_{12}X_{13}X_{14}X_{15}X_{16}QSGDLR$ $RHX_{17}X_{18}X_{19}HX_{20}X_{21}X_{22}X_{23}X_{24}X_8X_9CX_{10}X_{11}CX_{12}X_{13}X_{14}X_{15}X_{16}RSDH$ $LTTHX_{17}X_{18}X_{19}HX_{20}X_{21}X_{22}X_{23}X_{24}X_8X_9CX_{10}X_{11}CX_{12}X_{13}X_{14}X_{15}X_{16}DC$ $RDLARHX_{17}X_{18}X_{19}HX_{20}X_{21}X_{22}X_{23}X_{24}X_{25}X_{26}X_{27}X_{28}X_{29}X_{30}$ | 2347 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gctggcctg taggaccaa cct | 1250 | GCT GGC CTG TAG GAC CAA CCT | LEPGEKPYKCPECGKSFSTKNSL TEHQRTHTGEKPYKCPECGKSFS QSGNLTEHQRTHTGEKPYKCPEC GKSFSDPGNLVRHQRTHTGEKPY KCPECGKSFSREDNLHTHQRTHT GEKPYKCPECGKSFSRNDALTEH QRTHTGEKPYKCPECGKSFSDPG HLVRHQRTHTGEKPYKCPECGKS FSTSGELVRHQRTHTGEKPTGKK TS | 1799 | $X_1X_2X_3X_4X_5X_6X_7X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}QSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}DPGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}REDNLHTHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_{25}X_{26}X_{27}X_{28}X_{29}X_{30}TSGELVRHX_{17}X_{18}X_{19}HX_{20}X_{21}X_{22}X_{23}X_{24}X_{25}X_{26}X_{27}X_{28}X_{29}X_{30}$ | 2348 |
| ggcctgtag gaccaacct acc | 1251 | GGC CTG TAG GAC CAA CCT ACC | LEPGEKPYKCPECGKSFSDKKDL TRHQRTHTGEKPYKCPECGKSFS TKNSLTEHQRTHTGEKPYKCPEC GKSFSQSGNLTEHQRTHTGEKPY KCPECGKSFSDPGNLVRHQRTHT GEKPYKCPECGKSFSREDNLHTH QRTHTGEKPYKCPECGKSFSRND ALTEHQRTHTGEKPYKCPECGKS FSDPGHLVRHQRTHTGEKPTGKK TS | 1800 | $X_1X_2X_3X_4X_5X_6X_7X_8X_9CX_{10}X_{11}CX_{12}X_{13}X_{14}X_{15}X_{16}DKKDLTRHX_{17}X_{18}X_{19}HX_{20}X_{21}X_{22}X_{23}X_{24}X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}QSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}DPGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}REDNLHTHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_{25}X_{26}X_{27}X_{28}X_{29}X_{30}$ | 2349 |
| ctgtaggac caacctacc att | 1252 | CTG TAG GAC CAA CCT ACC ATT | LEPGEKPYKCPECGKSFSHKNAL QNHQRTHTGEKPYKCPECGKSFS DKKDLTRHQRTHTGEKPYKCPEC GKSFSTKNSLTEHQRTHTGEKPY KCPECGKSFSQSGNLTEHQRTHT GEKPYKCPECGKSFSDPGNLVRH QRTHTGEKPYKCPECGKSFSRED NLHTHQRTHTGEKPYKCPECGKS FSRNDALTEHQRTHTGEKPTGKK TS | 1801 | $X_1X_2X_3X_4X_5X_6X_7X_8X_9CX_{10}X_{11}CX_{12}X_{13}X_{14}X_{15}X_{16}HKNALQNHX_{17}X_{18}X_{19}HX_{20}X_{21}X_{22}X_{23}X_{24}X_8X_9CX_{10}X_{11}CX_{12}X_{13}X_{14}X_{15}X_{16}DKKDLTRHX_{17}X_{18}X_{19}HX_{20}X_{21}X_{22}X_{23}X_{24}X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}QSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}DPGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}REDNLHTHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_{25}X_{26}X_{27}X_{28}X_{29}X_{30}$ | 2350 |
| ccacccccaa agttgagtg cca | 1253 | CCA CCC CAA AGT TGA gtg CCA | LEPGEKPYKCPECGKSFSTHSHL TEHQRTHTGEKPYKCPECGKSFS RSDELVRHQRTHTGEKPYKCPEC GKSFSQAGHLASHQRTHTGEKPY KCPECGKSFSHRTLTNHQRTHT GEKPYKCPECGKSFSQSGNLTEH QRTHTGEKPYKCPECGKSFSSKK HLAEHQRTHTGEKPYKCPECGKS FSTSHSLTEHQRTHTGEKPTGKK TS | 1802 | $X_1X_2X_3X_4X_5X_6X_7X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}QAGHLASHX_{17}X_{18}X_{19}HX_{20}X_{21}X_{22}X_{23}X_{24}X_8X_9CX_{10}X_{11}CX_{12}X_{13}X_{14}X_{15}X_{16}HRTTLTNHX_{17}X_{18}X_{19}HX_{20}X_{21}X_{22}X_{23}X_{24}X_8X_9CX_{10}X_{11}CX_{12}X_{13}X_{14}X_{15}X_{16}QSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_{25}X_{26}X_{27}X_{28}X_{29}X_{30}$ | 2351 |

TABLE 10-continued

| Column 1 Nucleotide Sequence of Target Site in HNF4α Expression Control Region | Column 2 Target sequence with space | Column 3 Target sequence | Column 4 Amino acid Sequence of Zinc Finger DNA Binding Domain Polypeptides Targeting the Target Site in Column 1 | Column 5 SEQ ID NO. (corresponds to sequences in Columns 1 and 3) | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| ccccaaagt tgagtgcca aag | CCC CAA AGT TGA gtg CCA AAG | | LEPGEKPYKCPECGKSFSRKDNL KNHQRTHTGEKPYKCPECGKSFS TSHSLTEHQRTHTGEKPYKCPEC GKSFSRSDELVRHQRTHTGEKPY KCPECGKSFSQAGHLASHQRTHT GEKPYKCPECGKSFSHRTTLTNH QRTHTGEKPYKCPECGKSFSQSG NLTEHQRTHTGEKPYKCPECGKS FSSKKHLAEHQRTHTGEKPTGKK TS | 1254 | $X_1X_2X_3X_4X_5X_6X_7X_8X_9CX_{10}X_{11}CX_{12}X_{13}X_{14}X_{15}X_{16}RKDNLKNHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}CX_{12}X_{13}X_{14}X_{15}X_{16}QAGHLASHX_{17}X_{18}X_{19}HX_{20}X_{21}CX_{12}X_{13}X_{14}X_{15}X_{16}HRTTLTNHX_{17}X_{18}X_{19}HX_{20}X_{21}X_{22}X_{23}X_{24}X_8X_9CX_{10}X_{11}CX_{12}X_{13}X_{14}X_{15}X_{16}QSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_{25}X_{26}X_{27}X_{28}X_{29}X_{30}$ | 2352 |
| gctcctgga cccaggcac acc | GCT CCT GGA CCC AGG CAC ACC | | LEPGEKPYKCPECGKSFSDKKDL TRHQRTHTGEKPYKCPECGKSFS SKKALTEHQRTHTGEKPYKCPEC GKSFSRSDHLTNHQRTHTGEKPY KCPECGKSSKKHLAEHQRTHT GEKPYKCPECGKSFSQRAHLERH QRTHTGEKPYKCPECGKSFSTKN SLTEHQRTHTGEKPYKCPECGKS FSTSGELVRHQRTHTGEKPTGKK TS | 1255 | $X_1X_2X_3X_4X_5X_6X_7X_8X_9CX_{10}X_{11}CX_{12}X_{13}X_{14}X_{15}X_{16}DKKDLTRHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_{25}X_{26}X_{27}X_{28}X_{29}X_{30}$ | 2353 |
| ctggaccca ggcacacct gcc | CTG GAC CCA GGC ACA CCT GCC | | LEPGEKPYKCPECGKSFSDCRDL ARHQRTHTGEKPYKCPECGKSFS TKNSLTEHQRTHTGEKPYKCPEC GKSFSSPADLTRHQRTHTGEKPY KCPECGKSFSDPGHLVRHQRTHT GEKPYKCPECGKSFSTSHSLTEH QRTHTGEKPYKCPECGKSFSDPG NLVRHQRTHTGEKPYKCPECGKS FSRNDALTEHQRTHTGEKPTGKK TS | 1256 | $X_1X_2X_3X_4X_5X_6X_7X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}DPGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_{25}X_{26}X_{27}X_{28}X_{29}X_{30}$ | 2354 |
| gccccacct ggcaccct ggg | GCC CCA CCT GGC ACC CCT GGG | | LEPGEKPYKCPECGKSFSRSDKL VRHQRTHTGEKPYKCPECGKSFS TKNSLTEHQRTHTGEKPYKCPEC GKSFSSPADLTRHQRTHTGEKPY KCPECGKSFSDPGHLVRHQRTHT GEKPYKCPECGKSFSTHLDLIRH QRTHTGEKPYKCPECGKSFSSKK HLAEHQRTHTGEKPYKCPECGKS FSDCRDLARHQRTHTGEKPTGKK TS | 1257 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}HX_{20}X_{20}X_{22}X_{23}X_{24}X_8X_9CX_{10}X_{11}X_4X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}THLDLRHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_{25}X_{26}X_{27}X_{28}X_{29}X_{30}$ | 2355 |

TABLE 10-continued

| Column 1 Nucleotide Sequence of Target Site in HNF4α Expression Control Region | Column 3 Target sequence with space | Column 2 SEQ ID NO. (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| cctgccccc actggcaca cct | CCT GCC CCC ACT GGC ACA CCT | 1258 | LEPGEKPYKCPECGKSFSTKNSL TEHQRTHTGEKPYKCPECGKSFS SPADLTRHQRTHTGEKPYKCPEC GKSFSDPGHLVRHQRTHTGEKPY KCPECGKSFSTHLDLIRHQRTHT GEKPYKCPECGKSFSSKKHLAEH QRTHTGEKPYKCPECGKSFSDCR DLARHQRTHTGEKPYKCPECGKS FSTKNSLTEHQRTHTGEKPTGKK TS | 1807 | $X_1X_2X_3X_4X_5X_6X_7X_8X_9CX_{10}X_{11}CX_{12}X_{13}X_{14}X_{15}X_{16}$TKNSLTEH$X_{17}X_{18}X_{19}$H$X_{20}X_{21}X_{22}X_{23}X_{24}X_8X_9CX_{10}X_{11}CX_{12}X_{13}X_{14}X_{15}X_{16}$SPADLTRH$X_{17}X_{18}$ $X_{19}HX_{20}X_{21}X_{22}X_{23}X_{24}X_8X_9CX_{10}X_{11}CX_{12}X_{13}X_{14}X_{15}X_{16}$DPGHLVRH$X_{17}$ $X_{18}X_{19}HX_{20}X_{21}X_{22}X_{23}X_{24}X_8X_9CX_{10}X_{11}CX_{12}X_{13}X_{14}X_{15}X_{16}$THLDLIRH $X_{17}X_{18}X_{19}HX_{20}X_{21}X_{22}X_{23}X_{24}X_8X_9CX_{10}X_{11}CX_{12}X_{13}X_{14}X_{15}X_{16}$SKKHLA EH$X_{17}X_{18}X_{19}HX_{20}X_{21}X_{22}X_{23}X_{24}X_8X_9CX_{10}X_{11}CX_{12}X_{13}X_{14}X_{15}X_{16}$DCRD LARH$X_{17}X_{18}X_{19}HX_{20}X_{21}X_{22}X_{23}X_{24}X_8X_9CX_{10}X_{11}CX_{12}X_{13}X_{14}X_{15}X_{16}$TK NSLTEH$X_{17}X_{18}X_{19}HX_{20}X_{21}X_{22}X_{23}X_{24}X_{25}X_{26}X_{27}X_{28}X_{29}X_{30}$ | 2356 |
| ggcacacct gcccccact ggc | GGC ACA CCT GCC CCC ACT GGC | 1259 | LEPGEKPYKCPECGKSFSDPGHL VRHQRTHTGEKPYKCPECGKSFS THLDLIRHQRTHTGEKPYKCPEC GKSFSSKKHLAEHQRTHTGEKPY KCPECGKSFSDCRDLARHQRTHT GEKPYKCPECGKSFSTKNSLTEH QRTHTGEKPYKCPECGKSFSSPA DLTRHQRTHTGEKPYKCPECGKS FSDPGHLVRHQRTHTGEKPTGKK TS | 1808 | $X_1X_2X_3X_4X_5X_6X_7X_8X_9CX_{10}X_{11}CX_{12}X_{13}X_{14}X_{15}X_{16}$DPGHLVRH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$THLDLIRH$X_{17}X_{18}$ $X_{19}HX_{20}X_{21}X_{22}X_{23}X_{24}X_8X_9CX_{10}X_{11}CX_{12}X_{13}X_{14}X_{15}X_{16}$SKKHLAEH$X_{17}$ $X_{18}X_{19}HX_{20}X_{21}X_{22}X_{23}X_{24}X_8X_9CX_{10}X_{11}CX_{12}X_{13}X_{14}X_{15}X_{16}$DCRDLARH $X_{17}X_{18}X_{19}HX_{20}X_{21}X_{22}X_{23}X_{24}X_8X_9CX_{10}X_{11}CX_{12}X_{13}X_{14}X_{15}X_{16}$TKNSLT EH$X_{17}X_{18}X_{19}HX_{20}X_{21}X_{22}X_{23}X_{24}X_8X_9CX_{10}X_{11}CX_{12}X_{13}X_{14}X_{15}X_{16}$SPAD LTRH$X_{17}X_{18}X_{19}HX_{20}X_{21}X_{22}X_{23}X_{24}X_8X_9CX_{10}X_{11}CX_{12}X_{13}X_{14}X_{15}X_{16}$DP GHLVRH$X_{17}X_{18}X_{19}HX_{20}X_{21}X_{22}X_{23}X_{24}X_{25}X_{26}X_{27}X_{28}X_{29}X_{30}$ | 2357 |
| acacctgcc cccactggc aca | ACA CCT GCC CCC ACT GGC ACA | 1260 | LEPGEKPYKCPECGKSFSSPADL TRHQRTHTGEKPYKCPECGKSFS DPGHLVRHQRTHTGEKPYKCPEC GKSFSTHLDLIRHQRTHTGEKPY KCPECGKSFSSKKHLAEHQRTHT GEKPYKCPECGKSFSDCRDLARH QRTHTGEKPYKCPECGKSFSTKN SLTEHQRTHTGEKPYKCPECGKS FSSPADLTRHQRTHTGEKPTGKK TS | 1809 | $X_1X_2X_3X_4X_5X_6X_7X_8X_9CX_{10}X_{11}CX_{12}X_{13}X_{14}X_{15}X_{16}$SPADLTRH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$DPGHLVRH$X_{17}X_{18}$ $X_{19}HX_{20}X_{21}X_{22}X_{23}X_{24}X_8X_9CX_{10}X_{11}CX_{12}X_{13}X_{14}X_{15}X_{16}$THLDLIRH$X_{17}$ $X_{18}X_{19}HX_{20}X_{21}X_{22}X_{23}X_{24}X_8X_9CX_{10}X_{11}CX_{12}X_{13}X_{14}X_{15}X_{16}$SKKHLAEH $X_{17}X_{18}X_{19}HX_{20}X_{21}X_{22}X_{23}X_{24}X_8X_9CX_{10}X_{11}CX_{12}X_{13}X_{14}X_{15}X_{16}$DCRDLA RH$X_{17}X_{18}X_{19}HX_{20}X_{21}X_{22}X_{23}X_{24}X_8X_9CX_{10}X_{11}CX_{12}X_{13}X_{14}X_{15}X_{16}$TKNS LTEH$X_{17}X_{18}X_{19}HX_{20}X_{21}X_{22}X_{23}X_{24}X_8X_9CX_{10}X_{11}CX_{12}X_{13}X_{14}X_{15}X_{16}$SP ADLTRH$X_{17}X_{18}X_{19}HX_{20}X_{21}X_{22}X_{23}X_{24}X_{25}X_{26}X_{27}X_{28}X_{29}X_{30}$ | 2358 |
| ccaggcaca cctgcccc act | CCA GGC ACA CCT GCC CCC ACT | 1261 | LEPGEKPYKCPECGKSFSTHLDL IRHQRTHTGEKPYKCPECGKSFS SKKHLAEHQRTHTGEKPYKCPEC GKSFSDCRDLARHQRTHTGEKPY KCPECGKSFSTKNSLTEHQRTHT GEKPYKCPECGKSFSSPADLTRH QRTHTGEKPYKCPECGKSFSDPG HLVRHQRTHTGEKPYKCPECGKS FSTSHSLTEHQRTHTGEKPTGKK TS | 1810 | $X_1X_2X_3X_4X_5X_6X_7X_8X_9CX_{10}X_{11}CX_{12}X_{13}X_{14}X_{15}X_{16}$THLDLIRH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$SKKHLAEH$X_{17}X_{18}$ $X_{19}HX_{20}X_{21}X_{22}X_{23}X_{24}X_8X_9CX_{10}X_{11}CX_{12}X_{13}X_{14}X_{15}X_{16}$DCRDLARH$X_{17}$ $X_{18}X_{19}HX_{20}X_{21}X_{22}X_{23}X_{24}X_8X_9CX_{10}X_{11}CX_{12}X_{13}X_{14}X_{15}X_{16}$TKNSLTEH $X_{17}X_{18}X_{19}HX_{20}X_{21}X_{22}X_{23}X_{24}X_8X_9CX_{10}X_{11}CX_{12}X_{13}X_{14}X_{15}X_{16}$SPADLT RH$X_{17}X_{18}X_{19}HX_{20}X_{21}X_{22}X_{23}X_{24}X_8X_9CX_{10}X_{11}CX_{12}X_{13}X_{14}X_{15}X_{16}$DPGH LVRH$X_{17}X_{18}X_{19}HX_{20}X_{21}X_{22}X_{23}X_{24}X_8X_9CX_{10}X_{11}CX_{12}X_{13}X_{14}X_{15}X_{16}$TS HSLTEH$X_{17}X_{18}X_{19}HX_{20}X_{21}X_{22}X_{23}X_{24}X_{25}X_{26}X_{27}X_{28}X_{29}X_{30}$ | 2359 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| cccactggc acactgggc cac | 1262 | CCC ACT GGC ACA CCT GGG CAC | LEPGEKPYKCPECGKSFSSKKAL TEHQRTHTGEKPYKCPECGKSFS RSDKLVRHQRTHTGEKPYKCPEC GKSFSTKNSLTEHQRTHTGEKPY KCPECGKSFSSPADLTRHQRTHT GEKPYKCPECGKSFSDPGHLVRH QRTHTGEKPYKCPECGKSFSTHL DLIRHQRTHTGEKPYKCPECGKS FSSKKHLAEHQRTHTGEKPTGKK TS | 1811 | $X_1X_2X_3X_4X_5X_6X_7X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}THLDLIRHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_{25}X_{26}X_{27}X_{28}X_{29}X_{30}$ | 2360 |
| gacccaggc acactggcc ccc | 1263 | GAC CCA GGC ACA CTG GCC CCC | LEPGEKPYKCPECGKSFSSKKHL AEHQRTHTGEKPYKCPECGKSFS DCRDLARHQRTHTGEKPYKCPEC GKSFSTKNSLTEHQRTHTGEKPY KCPECGKSFSSPADLTRHQRTHT GEKPYKCPECGKSFSDPGHLVRH QRTHTGEKPYKCPECGKSFSTSH SLTEHQRTHTGEKPYKCPECGKS FSDPGNLVRHQRTHTGEKPTGKK TS | 1812 | $X_1X_2X_3X_4X_5X_6X_7X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}DPGNLVRHX_{17}X_{18}X_{19}HX_{20}X_{21}X_{22}X_{23}X_{24}X_{25}X_{26}X_{27}X_{28}X_{29}X_{30}$ | 2361 |
| ccactggca cacctgggc aca | 1264 | CCA CTG GCA CAC CTG GGC ACA | LEPGEKPYKCPECGKSFSSPADL TRHQRTHTGEKPYKCPECGKSFS DPGHLVRHQRTHTGEKPYKCPEC GKSFSRNDALTEHQRTHTGEKPY KCPECGKSFSSKKALTEHQRTHT GEKPYKCPECGKSFSQSGDLRRH QRTHTGEKPYKCPECGKSFSRND ALTEHQRTHTGEKPYKCPECGKS FSTSHSLTEHQRTHTGEKPTGKK TS | 1813 | $X_1X_2X_3X_4X_5X_6X_7X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_{25}X_{26}X_{27}X_{28}X_{29}X_{30}$ | 2362 |
| gcacacctg ccccactg gca | 1265 | GCA CAC CTG CCC CAC TG GCA | LEPGEKPYKCPECGKSFSQSGDL RRHQRTHTGEKPYKCPECGKSFS RNDALTEHQRTHTGEKPYKCPEC GKSFSTSHSLTEHQRTHTGEKPY KCPECGKSSKKHLAEHQRTHT GEKPYKCPECGKSFSRNDALTEH QRTHTGEKPYKCPECGKSFSKKK ALTEHQRTHTGEKPYKCPECGKS FSQSGDLRRHQRTHTGEKPTGKK TS | 1814 | $X_1X_2X_3X_4X_5X_6X_7X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_{25}X_{26}X_{27}X_{28}X_{29}X_{30}$ | 2363 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| ctgcccca ctggcacac ctg | 1266 | CTG CCC CCA CAC GCA CAC CTG | LEPGEKPYKCPECGKSFSRNDAL TEHQRTHTGEKPYKCPECGKSFS SKKALTEHQRTHTGEKPYKCPEC GKSFSQSGDLRRHQRTHTGEKPY KCPECGKSFSRNDALTEHQRTHT GEKPYKCPECGKSFSTSHSLTEH QRTHTGEKPYKCPECGKSFSSKK HLAEHQRTHTGEKPYKCPECGKS FSRNDALTEHQRTHTGEKPTGKK TS | 1815 | $X_1X_2X_3X_4X_5X_6X_7X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{25}X_{26}X_{27}X_{28}X_{29}X_{30}$ | 2364 |
| cccccactg gcacacctg ggc | 1267 | CCC CCA CTG GCA CAC CTG GGC | LEPGEKPYKCPECGKSFSDPGHL VRHQRTHTGEKPYKCPECGKSFS RNDALTEHQRTHTGEKPYKCPEC GKSFSSKKALTEHQRTHTGEKPY KCPECGKSFSQSGDLRRHQRTHT GEKPYKCPECGKSFSRNDALTEH QRTHTGEKPYKCPECGKSFSTSH SLTEHQRTHTGEKPYKCPECGKS FSSKKHLAEHQRTHTGEKPTGKK TS | 1816 | $X_1X_2X_3X_4X_5X_6X_7X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{25}X_{26}X_{27}X_{28}X_{29}X_{30}$ | 2365 |
| caggcacac ctgccccca ctg | 1268 | CAG GCA CAC CTG CCC CCA CTG | LEPGEKPYKCPECGKSFSRNDAL TEHQRTHTGEKPYKCPECGKSFS TSHSLTEHQRTHTGEKPYKCPEC GKSFSSKKHLAEHQRTHTGEKPY KCPECGKSFSRNDALTEHQRTHT GEKPYKCPECGKSFSSKKALTEH QRTHTGEKPYKCPECGKSFSQSG DLRRHQRTHTGEKPYKCPECGKS FSRADNLTEHQRTHTGEKPTGKK TS | 1817 | $X_1X_2X_3X_4X_5X_6X_7X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{25}X_{26}X_{27}X_{28}X_{29}X_{30}$ | 2366 |
| tggaccag gcacacctg ccc | 1269 | TGG ACC CAG GCA CAC CTG CCC | LEPGEKPYKCPECGKSFSSKKHL AEHQRTHTGEKPYKCPECGKSFS RNDALTEHQRTHTGEKPYKCPEC GKSFSSKKALTEHQRTHTGEKPY KCPECGKSFSQSGDLRRHQRTHT GEKPYKCPECGKSFSRADNLTEH QRTHTGEKPYKCPECGKSFSDKK DLTRHQRTHTGEKPYKCPECGKS FSRSDHLTTHQRTHTGEKPTGKK TS | 1818 | $X_1X_2X_3X_4X_5X_6X_7X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}DKKDLTRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{25}X_{26}X_{27}X_{28}X_{29}X_{30}$ | 2367 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| acccaggca cacctgccc cca | 1270 | ACC CAG GCA CAC CTG CCC CCA | LEPGEKPYKCPECGKSFSTSHSL TEHQRTHTGEKPYKCPECGKSFS SKKHLAEHQRTHTGEKPYKCPEC GKSFSRNDALTEHQRTHTGEKPY KCPECGKSFSSKKALTEHQRTHT GEKPYKCPECGKSFSQSGDLRRH QRTHTGEKPYKCPECGKSFSRAD NLTEHQRTHTGEKPYKCPECGKS FSDKKDLTRHQRTHTGEKPTGKK TS | 1819 | $X_1X_2X_3X_4X_5X_6X_7X_8X_9CX_{10}X_{11}CX_{12}X_{13}X_{14}X_{15}X_{16}$TSHSLTEH$X_{17}X_{18}X_{19}$HX$_{20}X_{21}X_{22}X_{23}X_{24}X_8X_9CX_{10}X_{11}CX_{12}X_{13}X_{14}X_{15}X_{16}$SKKHLAEH$X_{17}X_{18}$X$_{19}$HX$_{20}X_{21}X_{22}X_{23}X_{24}X_8X_9CX_{10}X_{11}CX_{12}X_{13}X_{14}X_{15}X_{16}$RNDALTEH$X_{17}X_{18}$X$_{19}$HX$_{20}X_{21}X_{22}X_{23}X_{24}X_8X_9CX_{10}X_{11}CX_{12}X_{13}X_{14}X_{15}X_{16}$SKKALTEH$X_{17}X_{18}$X$_{19}$HX$_{20}X_{21}X_{22}X_{23}X_{24}X_8X_9CX_{10}X_{11}CX_{12}X_{13}X_{14}X_{15}X_{16}$QSGDLRRH$X_{17}X_{18}$X$_{19}$HX$_{20}X_{21}X_{22}X_{23}X_{24}X_8X_9CX_{10}X_{11}CX_{12}X_{13}X_{14}X_{15}X_{16}$RADNLTEH$X_{17}X_{18}$X$_{19}$HX$_{20}X_{21}X_{22}X_{23}X_{24}X_8X_9CX_{10}X_{11}CX_{12}X_{13}X_{14}X_{15}X_{16}$DKKDLTRH$X_{17}X_{18}X_{19}$HX$_{20}X_{21}X_{22}X_{23}X_{24}X_{25}X_{26}X_{27}X_{28}X_{29}X_{30}$ | 2368 |
| cacctgccc ccactggca cac | 1271 | CAC CTG CCC CCA CTG GCA CAC | LEPGEKPYKCPECGKSFSSKKAL TEHQRTHTGEKPYKCPECGKSFS QSGDLRRHQRTHTGEKPYKCPEC GKSFSRNDALTEHQRTHTGEKPY KCPECGKSFSTSHSLTEHQRTHT GEKPYKCPECGKSFSSKKHLAEH QRTHTGEKPYKCPECGKSFSRND ALTEHQRTHTGEKPYKCPECGKS FSSKKALTEHQRTHTGEKPTGKK TS | 1820 | $X_1X_2X_3X_4X_5X_6X_7X_8X_9CX_{10}X_{11}CX_{12}X_{13}X_{14}X_{15}X_{16}$SKKALTEH$X_{17}X_{18}X_{19}$HX$_{20}X_{21}X_{22}X_{23}X_{24}X_8X_9CX_{10}X_{11}CX_{12}X_{13}X_{14}X_{15}X_{16}$QSGDLRRH$X_{17}X_{18}$X$_{19}$HX$_{20}X_{21}X_{22}X_{23}X_{24}X_8X_9CX_{10}X_{11}CX_{12}X_{13}X_{14}X_{15}X_{16}$RNDALTEH$X_{17}X_{18}$X$_{19}$HX$_{20}X_{21}X_{22}X_{23}X_{24}X_8X_9CX_{10}X_{11}CX_{12}X_{13}X_{14}X_{15}X_{16}$TSHSLTEH$X_{17}X_{18}$X$_{19}$HX$_{20}X_{21}X_{22}X_{23}X_{24}X_8X_9CX_{10}X_{11}CX_{12}X_{13}X_{14}X_{15}X_{16}$SKKHLAEH$X_{17}X_{18}X_{19}$HX$_{20}X_{21}X_{22}X_{23}X_{24}X_8X_9CX_{10}X_{11}CX_{12}X_{13}X_{14}X_{15}X_{16}$RNDALTEH$X_{17}X_{18}X_{19}$HX$_{20}X_{21}X_{22}X_{23}X_{24}X_{25}X_{26}X_{27}X_{28}X_{29}X_{30}$SKKALTEH$X_{17}X_{18}X_{19}$HX$_{20}X_{21}X_{22}X_{23}X_{24}X_{25}X_{26}X_{27}X_{28}X_{29}X_{30}$ | 2369 |
| ccacctacc attgcccat cgt | 1272 | CCA CCT ACC ATT GCC CAT CGT | LEPGEKPYKCPECGKSFSSRRTC RAHQRTHTGEKPYKCPECGKSFS TSGNLTEHQRTHTGEKPYKCPEC GKSFSDCRDLARHQRTHTGEKPY KCPECGKSFSHKNALQNHQRTHT GEKPYKCPECGKSFSDKKDLTRH QRTHTGEKPYKCPECGKSFSTKN SLTEHQRTHTGEKPYKCPECGKS FSTSHSLTEHQRTHTGEKPTGKK TS | 1821 | $X_1X_2X_3X_4X_5X_6X_7X_8X_9CX_{10}X_{11}CX_{12}X_{13}X_{14}X_{15}X_{16}$SRRTCRAH$X_{17}X_{18}X_{19}$HX$_{20}X_{21}X_{22}X_{23}X_{24}X_8X_9CX_{10}X_{11}CX_{12}X_{13}X_{14}X_{15}X_{16}$TSGNLTEH$X_{17}X_{18}$X$_{19}$HX$_{20}X_{21}X_{22}X_{23}X_{24}X_8X_9CX_{10}X_{11}CX_{12}X_{13}X_{14}X_{15}X_{16}$DCRDLARH$X_{17}X_{18}$X$_{19}$HX$_{20}X_{21}X_{22}X_{23}X_{24}X_8X_9CX_{10}X_{11}CX_{12}X_{13}X_{14}X_{15}X_{16}$HKNALQNH$X_{17}X_{18}$X$_{19}$HX$_{20}X_{21}X_{22}X_{23}X_{24}X_8X_9CX_{10}X_{11}CX_{12}X_{13}X_{14}X_{15}X_{16}$DKKDLTRH$X_{17}X_{18}$X$_{19}$HX$_{20}X_{21}X_{22}X_{23}X_{24}X_8X_9CX_{10}X_{11}CX_{12}X_{13}X_{14}X_{15}X_{16}$TKNSLTEH$X_{17}X_{18}X_{19}$HX$_{20}X_{21}X_{22}X_{23}X_{24}X_{25}X_{26}X_{27}X_{28}X_{29}X_{30}$TSHSLTEH$X_{17}X_{18}X_{19}$HX$_{20}X_{21}X_{22}X_{23}X_{24}X_{25}X_{26}X_{27}X_{28}X_{29}X_{30}$ | 2370 |
| tggcacacc tgggcacat ctg | 1273 | TGG CAC ACC TGG GCA CAT CTG | LEPGEKPYKCPECGKSFSRNDAL TEHQRTHTGEKPYKCPECGKSFS TSGNLTEHQRTHTGEKPYKCPEC GKSFSQSGDLRRHQRTHTGEKPY KCPECGKSFSRSDHLTTHQRTHT GEKPYKCPECGKSFSDKKDLTRH QRTHTGEKPYKCPECGKSFSSKK ALTEHQRTHTGEKPYKCPECGKS FSRSDHLTTHQRTHTGEKPTGKK TS | 1822 | $X_1X_2X_3X_4X_5X_6X_7X_8X_9CX_{10}X_{11}CX_{12}X_{13}X_{14}X_{15}X_{16}$RNDALTEH$X_{17}X_{18}X_{19}$HX$_{20}X_{21}X_{22}X_{23}X_{24}X_8X_9CX_{10}X_{11}CX_{12}X_{13}X_{14}X_{15}X_{16}$TSGNLTEH$X_{17}X_{18}$X$_{19}$HX$_{20}X_{21}X_{22}X_{23}X_{24}X_8X_9CX_{10}X_{11}CX_{12}X_{13}X_{14}X_{15}X_{16}$QSGDLRRH$X_{17}X_{18}$X$_{19}$HX$_{20}X_{21}X_{22}X_{23}X_{24}X_8X_9CX_{10}X_{11}CX_{12}X_{13}X_{14}X_{15}X_{16}$RSDHLTTH$X_{17}X_{18}$X$_{19}$HX$_{20}X_{21}X_{22}X_{23}X_{24}X_8X_9CX_{10}X_{11}CX_{12}X_{13}X_{14}X_{15}X_{16}$DKKDLTRH$X_{17}X_{18}$X$_{19}$HX$_{20}X_{21}X_{22}X_{23}X_{24}X_8X_9CX_{10}X_{11}CX_{12}X_{13}X_{14}X_{15}X_{16}$SKKALTEH$X_{17}X_{18}X_{19}$HX$_{20}X_{21}X_{22}X_{23}X_{24}X_{25}X_{26}X_{27}X_{28}X_{29}X_{30}$RSDHLTTH$X_{17}X_{18}X_{19}$HX$_{20}X_{21}X_{22}X_{23}X_{24}X_{25}X_{26}X_{27}X_{28}X_{29}X_{30}$ | 2371 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| cactggcac acctgggca cat | 1274 | CAC TGG CAC ACC TGG GCA CAT | LEPGEKPYKCPECGKSFSTSGNL TEHQRTHTGEKPYKCPECGKSFS QSGDLRRHQRTHTGEKPYKCPEC GKSFSRSDHLTHQRTHTGEKPY KCPECGKSFSDKKDLTRHQRTHT GEKPYKCPECGKSFSSKKALTEH QRTHTGEKPYKCPECGKSFSRSD HLTTHQRTHTGEKPYKCPECGKS FSSKKALTEHQRTHTGEKPTGKK TS | 1823 | $X_1X_2X_3X_4X_5X_6X_7X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}DKKDLTRHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_{25}X_{26}X_{27}X_{28}X_{29}X_{30}$ | 2372 |
| ctgccccca cctaccatt gcc | 1275 | CTG CCC CCA CCT ACC ATT GCC | LEPGEKPYKCPECGKSFSDCRDL ARHQRTHTGEKPYKCPECGKSFS HKNALQNHQRTHTGEKPYKCPEC GKSFSDKKDLTRHQRTHTGEKPY KCPECGKSFSTKNSLTEHQRTHT GEKPYKCPECGKSFSTSHSLTEH QRTHTGEKPYKCPECGKSFSSKK HLAEHQRTHTGEKPYKCPECGKS FSRNDALTEHQRTHTGEKPTGKK TS | 1824 | $X_1X_2X_3X_4X_5X_6X_7X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}HKNALQNHX_{17}X_{18}X_{19}HX_{20}X_{21}X_{22}X_{23}X_{24}X_8X_9CX_{10}X_{11}CX_{12}X_{13}X_{14}X_{15}X_{16}DKKDLTRHX_{17}X_{18}X_{19}HX_{20}X_{21}X_{22}X_{23}X_{24}X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_{25}X_{26}X_{27}X_{28}X_{29}X_{30}$ | 2373 |
| tggcacat catctgccc cct | 1276 | TGG CAC AT CAT CTG CCC CCT | LEPGEKPYKCPECGKSFSTKNSL TEHQRTHTGEKPYKCPECGKSFS TSHSLTEHQRTHTGEKPYKCPEC GKSFSSKKHLAEHQRTHTGEKPY KCPECGKSFSRNDALTEHQRTHT GEKPYKCPECGKSFSTSGNLTEH QRTHTGEKPYKCPECGKSFSQSG DLRRHQRTHTGEKPYKCPECGKS FSRSDHLTTHQRTHTGEKPTGKK TS | 1825 | $X_1X_2X_3X_4X_5X_6X_7X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_{25}X_{26}X_{27}X_{28}X_{29}X_{30}$ | 2374 |
| acctggca catctgccc cca | 1277 | ACC TGG CA GCA CAT CTG CCC CCA | LEPGEKPYKCPECGKSFSTSHSL TEHQRTHTGEKPYKCPECGKSFS SKKHLAEHQRTHTGEKPYKCPEC GKSFSRNDALTEHQRTHTGEKPY KCPECGKSFSTSGNLTEHQRTHT GEKPYKCPECGKSFSQSGDLRRH QRTHTGEKPYKCPECGKSFSRSD HLTTHQRTHTGEKPYKCPECGKS FSDKKDLTRHQRTHTGEKPTGKK TS | 1826 | $X_1X_2X_3X_4X_5X_6X_7X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}DKKDLTRHX_{17}X_{18}X_{19}HX_{20}X_{21}X_{22}X_{23}X_{24}X_{25}X_{26}X_{27}X_{28}X_{29}X_{30}$ | 2375 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gcacactg ccccacct acc | 1278 | GCA CAT CTG CCC CCA CCT ACC | LEPGEKPYKCPECGKSFSDKKDL TRHQRTHTGEKPYKCPECGKSFS TKNSLTEHQRTHTGEKPYKCPEC GKSFSTSHSLTEHQRTHTGEKPY KCPECGKSFSSKKHLAEHQRTHT GEKPYKCPECGKSFSRNDALTEH QRTHTGEKPYKCPECGKSFSTSG NLTEHQRTHTGEKPYKCPECGKS FSQSGDLRRHQRTHTGEKPTGKK TS | 1827 | $X_1X_2X_3X_4X_5X_6X_7X_8X_9CX_{10}X_{11}CX_{12}X_{13}X_{14}X_{15}X_{16}DKKDLTRHX_{17}X_{18}X_{19}HX_{20}X_{21}X_{22}X_{23}X_{24}X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_{25}X_{26}X_{27}X_{28}X_{29}X_{30}$ | 2376 |
| cctaccatt gccatccgt caa | 1279 | CCT ACC ATT GCC CAT CGT CAA | LEPGEKPYKCPECGKSFSQSGNL TEHQRTHTGEKPYKCPECGKSFS SRRTCRAHQRTHTGEKPYKCPEC GKSFSTSGNLTEHQRTHTGEKPY KCPECGKSFSDCRDLARHQRTHT GEKPYKCPECGKSFSHKNALQNH QRTHTGEKPYKCPECGKSFSDKK DLTRHQRTHTGEKPYKCPECGKS FSTKNSLTEHQRTHTGEKPTGKK TS | 1828 | $X_1X_2X_3X_4X_5X_6X_7X_8X_9CX_{10}X_{11}CX_{12}X_{13}X_{14}X_{15}X_{16}QSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}SRRTCRAHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}HKNALQNHX_{17}X_{18}X_{19}HX_{20}X_{21}X_{22}X_{23}X_{24}X_8X_9CX_{10}X_{11}CX_{12}X_{13}X_{14}X_{15}X_{16}DKKDLTRHX_{17}X_{18}X_{19}HX_{20}X_{21}X_{22}X_{23}X_{24}X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_{25}X_{26}X_{27}X_{28}X_{29}X_{30}$ | 2377 |
| catctgccc ccacctacc att | 1280 | CAT CTG CCC CCA CCT ACC ATT | LEPGEKPYKCPECGKSFSHKNAL QNHQRTHTGEKPYKCPECGKSFS DKKDLTRHQRTHTGEKPYKCPEC GKSFSTKNSLTEHQRTHTGEKPY KCPECGKSFSTSHSLTEHQRTHT GEKPYKCPECGKSFSSKKHLAEH QRTHTGEKPYKCPECGKSFSRND ALTEHQRTHTGEKPYKCPECGKS FSTSGNLTEHQRTHTGEKPTGKK TS | 1829 | $X_1X_2X_3X_4X_5X_6X_7X_8X_9CX_{10}X_{11}CX_{12}X_{13}X_{14}X_{15}X_{16}HKNALQNHX_{17}X_{18}X_{19}HX_{20}X_{21}X_{22}X_{23}X_{24}X_8X_9CX_{10}X_{11}CX_{12}X_{13}X_{14}X_{15}X_{16}DKKDLTRHX_{17}X_{18}X_{19}HX_{20}X_{21}X_{22}X_{23}X_{24}X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_{25}X_{26}X_{27}X_{28}X_{29}X_{30}$ | 2378 |
| ccccactgg cacacctgg gca | 1281 | CCC CAC TGG CAC ACC TGG GCA | LEPGEKPYKCPECGKSFSQSGDL RRHQRTHTGEKPYKCPECGKSFS RSDHLTTHQRTHTGEKPYKCPEC GKSFSDKKDLTRHQRTHTGEKPY KCPECGKSFSSKKALTEHQRTHT GEKPYKCPECGKSFSRSDHLTTH QRTHTGEKPYKCPECGKSFSSKK ALTEHQRTHTGEKPYKCPECGKS FSSKKHLAEHQRTHTGEKPTGKK TS | 1830 | $X_1X_2X_3X_4X_5X_6X_7X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTRHX_{17}X_{18}X_{19}HX_{20}X_{21}X_{22}X_{23}X_{24}X_8X_9CX_{10}X_{11}CX_{12}X_{13}X_{14}X_{15}X_{16}DKKDLTRHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_{25}X_{26}X_{27}X_{28}X_{29}X_{30}$ | 2379 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| ccccacct accattgcc cat | 1282 | CCC CCA CCT ACC ATT GCC CAT | LEPGEKPYKCPECGKSFSTSGNL TEHQRTHTGEKPYKCPECGKSFS DCRDLARHQRTHTGEKPYKCPEC GKSFSHKNALQNHQRTHTGEKPY KCPECGKSFSDKKDLTRHQRTHT GEKYKCPECGKSFSTKNSLTEH QRTHTGEKPYKCPECGKSFSTSH SLTEHQRTHTGEKPYKCPECGKS FSSKKHLAEHQRTHTGEKPTGKK TS | 1831 | $X_1X_2X_3X_4X_5X_6X_7X_8X_9CX_{10}X_{11}CX_{12}X_{13}X_{14}X_{15}X_{16}$TSGNLTEHX$_{17}X_{18}X_{19}$HX$_{20}X_{21}X_{22}X_{23}X_{24}X_8X_9$CX$_{10}X_{11}$CX$_{12}X_{13}X_{14}X_{15}X_{16}$DCRDLARHX$_{17}X_{18}$X$_{19}$HX$_{20}X_{21}X_{22}X_{23}X_{24}X_8X_9$CX$_{10}X_{11}$CX$_{12}X_{13}X_{14}X_{15}X_{16}$HKNALQNHX$_{17}$X$_{18}X_{19}$HX$_{20}X_{21}X_{22}X_{23}X_{24}X_8X_9$CX$_{10}X_{11}$CX$_{12}X_{13}X_{14}X_{15}X_{16}$DKKDLTRH X$_{17}X_{18}X_{19}$HX$_{20}X_{21}X_{22}X_{23}X_{24}X_8X_9$CX$_{10}X_{11}$CX$_{12}X_{13}X_{14}X_{15}X_{16}$TKNSLT EHX$_{17}X_{18}X_{19}$HX$_{20}X_{21}X_{22}X_{23}X_{24}X_8X_9$CX$_{10}X_{11}$CX$_{12}X_{13}X_{14}X_{15}X_{16}$TSHS LTEHX$_{17}X_{18}X_{19}$HX$_{20}X_{21}X_{22}X_{23}X_{24}X_8X_9$CX$_{10}X_{11}$CX$_{12}X_{13}X_{14}X_{15}X_{16}$SK KHLAEHX$_{17}X_{18}X_{19}$HX$_{20}X_{21}X_{22}X_{23}X_{24}X_{25}X_{26}X_{27}X_{28}X_{29}X_{30}$ | 2380 |
| cacacctgg gcacactgc ccc | 1283 | CAC ACC TGG GCA CAC TGC CCC | LEPGEKPYKCPECGKSFSSKKHL AEHQRTHTGEKPYKCPECGKSFS RNDALTEHQRTHTGEKPYKCPEC GKSFSTSGNLTEHQRTHTGEKPY KCPECGKSFSQSGDLRRHQRTHT GEKPYKCPECGKSFSRSDHLTTH QRTHTGEKPYKCPECGKSFSDKK DLTRHQRTHTGEKPYKCPECGKS FSSKKALTEHQRTHTGEKPTGKK TS | 1832 | $X_1X_2X_3X_4X_5X_6X_7X_8X_9$CX$_{10}X_{11}$CX$_{12}X_{13}X_{14}X_{15}X_{16}$SKKHLAEHX$_{17}X_{18}X_{19}$HX$_{20}X_{21}X_{22}X_{23}X_{24}X_8X_9$CX$_{10}X_{11}$CX$_{12}X_{13}X_{14}X_{15}X_{16}$RNDALTEHX$_{17}X_{18}$X$_{19}$HX$_{20}X_{21}X_{22}X_{23}X_{24}X_8X_9$CX$_{10}X_{11}$CX$_{12}X_{13}X_{14}X_{15}X_{16}$TSGNLTEHX$_{17}$X$_{18}X_{19}$HX$_{20}X_{21}X_{22}X_{23}X_{24}X_8X_9$CX$_{10}X_{11}$CX$_{12}X_{13}X_{14}X_{15}X_{16}$QSGDLRRH X$_{17}X_{18}X_{19}$HX$_{20}X_{21}X_{22}X_{23}X_{24}X_8X_9$CX$_{10}X_{11}$CX$_{12}X_{13}X_{14}X_{15}X_{16}$RSDHLT THX$_{17}X_{18}X_{19}$HX$_{20}X_{21}X_{22}X_{23}X_{24}X_8X_9$CX$_{10}X_{11}$CX$_{12}X_{13}X_{14}X_{15}X_{16}$DKKD LTRHX$_{17}X_{18}X_{19}$HX$_{20}X_{21}X_{22}X_{23}X_{24}X_8X_9$CX$_{10}X_{11}$CX$_{12}X_{13}X_{14}X_{15}X_{16}$SK KALTEHX$_{17}X_{18}X_{19}$HX$_{20}X_{21}X_{22}X_{23}X_{24}X_{25}X_{26}X_{27}X_{28}X_{29}X_{30}$ | 2381 |
| attgccat cgtcaacac ctg | 1284 | ATT GCC CAT CGT CAA CAC CTG | LEPGEKPYKCPECGKSFSRNDAL TEHQRTHTGEKPYKCPECGKSFS SKKALTEHQRTHTGEKPYKCPEC GKSFSQSGNLTEHQRTHTGEKPY KCPECGKSFSSRRTCRAHQRTHT GEKPYKCPECGKSFSTSGNLTEH QRTHTGEKPYKCPECGKSFSDCR DLARHQRTHTGEKPYKCPECGKS FSHKNALQNHQRTHTGEKPTGKK TS | 1833 | $X_1X_2X_3X_4X_5X_6X_7X_8X_9$CX$_{10}X_{11}$CX$_{12}X_{13}X_{14}X_{15}X_{16}$RNDALTEHX$_{17}X_{18}X_{19}$HX$_{20}X_{21}X_{22}X_{23}X_{24}X_8X_9$CX$_{10}X_{11}$CX$_{12}X_{13}X_{14}X_{15}X_{16}$SKKALTEHX$_{17}X_{18}$X$_{19}$HX$_{20}X_{21}X_{22}X_{23}X_{24}X_8X_9$CX$_{10}X_{11}$CX$_{12}X_{13}X_{14}X_{15}X_{16}$QSGNLTEHX$_{17}$X$_{18}X_{19}$HX$_{20}X_{21}X_{22}X_{23}X_{24}X_8X_9$CX$_{10}X_{11}$CX$_{12}X_{13}X_{14}X_{15}X_{16}$SRRTCRAH X$_{17}X_{18}X_{19}$HX$_{20}X_{21}X_{22}X_{23}X_{24}X_8X_9$CX$_{10}X_{11}$CX$_{12}X_{13}X_{14}X_{15}X_{16}$TSGNLT EHX$_{17}X_{18}X_{19}$HX$_{20}X_{21}X_{22}X_{23}X_{24}X_8X_9$CX$_{10}X_{11}$CX$_{12}X_{13}X_{14}X_{15}X_{16}$DCRD LARHX$_{17}X_{18}X_{19}$HX$_{20}X_{21}X_{22}X_{23}X_{24}X_8X_9$CX$_{10}X_{11}$CX$_{12}X_{13}X_{14}X_{15}X_{16}$HK NALQNHX$_{17}X_{18}X_{19}$HX$_{20}X_{21}X_{22}X_{23}X_{24}X_{25}X_{26}X_{27}X_{28}X_{29}X_{30}$ | 2382 |
| catcgtcaa cacctgcac att | 1285 | CAT CGT CAA CAC CTG CAC ATT | LEPGEKPYKCPECGKSFSHKNAL QNHQRTHTGEKPYKCPECGKSFS SKKALTEHQRTHTGEKPYKCPEC GKSFSRNDALTEHQRTHTGEKPY KCPECGKSFSSKKALTEHQRTHT GEKPYKCPECGKSFSQSGNLTEH QRTHTGEKPYKCPECGKSFSSRR TCRAHQRTHTGEKPYKCPECGKS FSTSGNLTEHQRTHTGEKPTGKK TS | 1834 | $X_1X_2X_3X_4X_5X_6X_7X_8X_9$CX$_{10}X_{11}$CX$_{12}X_{13}X_{14}X_{15}X_{16}$HKNALQNHX$_{17}X_{18}X_{19}$HX$_{20}X_{21}X_{22}X_{23}X_{24}X_8X_9$CX$_{10}X_{11}$CX$_{12}X_{13}X_{14}X_{15}X_{16}$SKKALTEHX$_{17}X_{18}$X$_{19}$HX$_{20}X_{21}X_{22}X_{23}X_{24}X_8X_9$CX$_{10}X_{11}$CX$_{12}X_{13}X_{14}X_{15}X_{16}$RNDALTEHX$_{17}$X$_{18}X_{19}$HX$_{20}X_{21}X_{22}X_{23}X_{24}X_8X_9$CX$_{10}X_{11}$CX$_{12}X_{13}X_{14}X_{15}X_{16}$SKKALTEH X$_{17}X_{18}X_{19}$HX$_{20}X_{21}X_{22}X_{23}X_{24}X_8X_9$CX$_{10}X_{11}$CX$_{12}X_{13}X_{14}X_{15}X_{16}$QSGNLT EHX$_{17}X_{18}X_{19}$HX$_{20}X_{21}X_{22}X_{23}X_{24}X_8X_9$CX$_{10}X_{11}$CX$_{12}X_{13}X_{14}X_{15}X_{16}$SRRT CRAHX$_{17}X_{18}X_{19}$HX$_{20}X_{21}X_{22}X_{23}X_{24}X_8X_9$CX$_{10}X_{11}$CX$_{12}X_{13}X_{14}X_{15}X_{16}$TS GNLTEHX$_{17}X_{18}X_{19}$HX$_{20}X_{21}X_{22}X_{23}X_{24}X_{25}X_{26}X_{27}X_{28}X_{29}X_{30}$ | 2383 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| accattgcc catcgtcaa cac | 1286 | ACC ATT GCC CAT CGT CAA CAC | LEPGEKPYKCPECGKSFSSKKAL TEHQRTHTGEKPYKCPECGKSFS QSGNLTEHQRTHTCRAHQRTHTGEKPY KCPECGKSFSTSGNLTEHQRTHT GEKPYKCPECGKSFSDCRDLARH QRTHTGEKPYKCPECGKSFSHKN ALQNHQRTHTGEKPYKCPECGKS FSDKKDLTRHQRTHTGEKPTGKK TS | 1835 | $X_1X_2X_3X_4X_5X_6X_7X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}QSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}SRRTCRAHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLTEH X_{17}X_{18}X_{19}HX_{20}X_{21}X_{22}X_{23}X_{24}X_8X_9CX_{10}X_{11}CX_{12}X_{13}X_{14}X_{15}X_{16}DCRDLA RHX_{17}X_{18}X_{19}HX_{20}X_{21}X_{22}X_{23}X_{24}X_8X_9CX_{10}X_{11}CX_{12}X_{13}X_{14}X_{15}X_{16}HKNA LQNHX_{17}X_{18}X_{19}HX_{20}X_{21}X_{22}X_{23}X_{24}X_8X_9CX_{10}X_{11}CX_{12}X_{13}X_{14}X_{15}X_{16}DK KDLTRHX_{17}X_{18}X_{19}HX_{20}X_{21}X_{22}X_{23}X_{24}X_{25}X_{26}X_{27}X_{28}X_{29}X_{30}$ | 2384 |
| gccatcgt caacactg cac | 1287 | GCC CAT CGT CAA CAC CTG CAC | LEPGEKPYKCPECGKSFSSKKAL TEHQRTHTGEKPYKCPECGKSFS RNDALTEHQRTHTGEKPYKCPEC GKSFSSKKALTEHQRTHTGEKPY KCPECGKSFSQSGNLTEHQRTHT GEKPYKCPECGKSFSSRRTCRAH QRTHTGEKPYKCPECGKSFSTSG NLTEHQRTHTGEKPYKCPECGKS FSDCRDLARHQRTHTGEKPTGKK TS | 1836 | $X_1X_2X_3X_4X_5X_6X_7X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}QSGNLTEH X_{17}X_{18}X_{19}HX_{20}X_{21}X_{22}X_{23}X_{24}X_8X_9CX_{10}X_{11}CX_{12}X_{13}X_{14}X_{15}X_{16}SRRTCR AHX_{17}X_{18}X_{19}HX_{20}X_{21}X_{22}X_{23}X_{24}X_8X_9CX_{10}X_{11}CX_{12}X_{13}X_{14}X_{15}X_{16}TSGN LTEHX_{17}X_{18}X_{19}HX_{20}X_{21}X_{22}X_{23}X_{24}X_8X_9CX_{10}X_{11}CX_{12}X_{13}X_{14}X_{15}X_{16}DC RDLARHX_{17}X_{18}X_{19}HX_{20}X_{21}X_{22}X_{23}X_{24}X_{25}X_{26}X_{27}X_{28}X_{29}X_{30}$ | 2385 |
| caggtggt gtaggctgg gtc | 1288 | CAG GGT GTA GGC TGG GTC | LEPGEKPYKCPECGKSFSDPGAL VRHQRTHTGEKPYKCPECGKSFS RSDHLTTHQRTHTGEKPYKCPEC GKSFSDPGHLVRHQRTHTGEKPY KCPECGKSFSQSSSLVRHQRTHT GEKPYKCPECGKSFSTSGHLVRH QRTHTGEKPYKCPECGKSFSTSG HLVRHQRTHTGEKPYKCPECGKS FSRADNLTEHQRTHTGEKPTGKK TS | 1837 | $X_1X_2X_3X_4X_5X_6X_7X_8X_9CX_{10}X_{11}CX_{12}X_{13}X_{14}X_{15}X_{16}DPGALVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSSSLVRH X_{17}X_{18}X_{19}HX_{20}X_{21}X_{22}X_{23}X_{24}X_8X_9CX_{10}X_{11}CX_{12}X_{13}X_{14}X_{15}X_{16}TSGHLV RHX_{17}X_{18}X_{19}HX_{20}X_{21}X_{22}X_{23}X_{24}X_8X_9CX_{10}X_{11}CX_{12}X_{13}X_{14}X_{15}X_{16}TSGH LVRHX_{17}X_{18}X_{19}HX_{20}X_{21}X_{22}X_{23}X_{24}X_8X_9CX_{10}X_{11}CX_{12}X_{13}X_{14}X_{15}X_{16}RA DNLTEHX_{17}X_{18}X_{19}HX_{20}X_{21}X_{22}X_{23}X_{24}X_{25}X_{26}X_{27}X_{28}X_{29}X_{30}$ | 2386 |
| ggtggtgta ggctgggtc cag | 1289 | GGT GGT GTA GGC TGG GTC CAG | LEPGEKPYKCPECGKSFSRADNL TEHQRTHTGEKPYKCPECGKSFS DPGALVRHQRTHTGEKPYKCPEC GKSFSRSDHLTTHQRTHTGEKPY KCPECGKSFSDPGHLVRHQRTHT GEKPYKCPECGKSFSQSSSLVRH QRTHTGEKPYKCPECGKSFSTSG HLVRHQRTHTGEKPYKCPECGKS FSTSGHLVRHQRTHTGEKPTGKK TS | 1838 | $X_1X_2X_3X_4X_5X_6X_7X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}DPGALVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRH X_{17}X_{18}X_{19}HX_{20}X_{21}X_{22}X_{23}X_{24}X_8X_9CX_{10}X_{11}CX_{12}X_{13}X_{14}X_{15}X_{16}QSSSLV RHX_{17}X_{18}X_{19}HX_{20}X_{21}X_{22}X_{23}X_{24}X_8X_9CX_{10}X_{11}CX_{12}X_{13}X_{14}X_{15}X_{16}TSGH LVRHX_{17}X_{18}X_{19}HX_{20}X_{21}X_{22}X_{23}X_{24}X_8X_9CX_{10}X_{11}CX_{12}X_{13}X_{14}X_{15}X_{16}TS GHLVRHX_{17}X_{18}X_{19}HX_{20}X_{21}X_{22}X_{23}X_{24}X_{25}X_{26}X_{27}X_{28}X_{29}X_{30}$ | 2387 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| aggctgggt ccagtcag cac | 1290 | AGG CTG GGT CCA GTC AGC AC | LEPGEKPYKCPECGKSFSKKAL TEHQRTHTGEKPYKCPECGKSFS RADNLTEHQRTHTGEKPYKCPEC GKSFSRSDELVRHQRTHTGEKPY KCPECGKSFSTSHSLTEHQRTHT GEKPYKCPECGKSFSTSGHLVRH QRTHTGEKPYKCPECGKSFSRND ALTEHQRTHTGEKPYKCPECGKS FSRSDHLTNHQRTHTGEKPTGKK TS | 1839 | $X_1X_2X_3X_4X_5X_6X_7X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEH X_{17}X_{18}X_{19}HX_{20}X_{21}X_{22}X_{23}X_{24}X_8X_9CX_{10}X_{11}CX_{12}X_{13}X_{14}X_{15}X_{16}TSGHLV RHX_{17}X_{18}X_{19}HX_{20}X_{21}X_{22}X_{23}X_{24}X_8X_9CX_{10}X_{11}CX_{12}X_{13}X_{14}X_{15}X_{16}RNDA LTEHX_{17}X_{18}X_{19}HX_{20}X_{21}X_{22}X_{23}X_{24}X_8X_9CX_{10}X_{11}CX_{12}X_{13}X_{14}X_{15}X_{16}RS DHLTNHX_{17}X_{18}X_{19}HX_{20}X_{21}X_{22}X_{23}X_{24}X_{25}X_{26}X_{27}X_{28}X_{29}X_{30}$ | 2388 |
| agcactgta gtcggccat gtc | 1291 | AGC ACT GTA GTC GGC CAT GTC | LEPGEKPYKCPECGKSFSDPGAL VRHQRTHTGEKPYKCPECGKSFS TSGNLTEHQRTHTGEKPYKCPEC GKSFSDPGHLVRHQRTHTGEKPY KCPECGKSFSDPGALVRHQRTHT GEKPYKCPECGKSFSQSSLVRH QRTHTGEKPYKCPECGKSFSTHL DLIRHQRTHTGEKPYKCPECGKS FSERSHLREHQRTHTGEKPTGKK TS | 1840 | $X_1X_2X_3X_4X_5X_6X_7X_8X_9CX_{10}X_{11}CX_{12}X_{13}X_{14}X_{15}X_{16}DPGALVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}DPGALVRH X_{17}X_{18}X_{19}HX_{20}X_{21}X_{22}X_{23}X_{24}X_8X_9CX_{10}X_{11}CX_{12}X_{13}X_{14}X_{15}X_{16}QSS\ SLV RHX_{17}X_{18}X_{19}HX_{20}X_{21}X_{22}X_{23}X_{24}X_8X_9CX_{10}X_{11}CX_{12}X_{13}X_{14}X_{15}X_{16}THLD LIRHX_{17}X_{18}X_{19}HX_{20}X20X_{22}X_{23}X_{24}X_8X_9CX_{10}X_{11}CX_{12}X_{13}X_{14}X_{15}X_{16}ER SHLREHX_{17}X_{18}X_{19}HX_{20}X20X_{22}X_{23}X_{24}X_{25}X_{26}X_{27}X_{28}X_{29}X_{30}$ | 2389 |
| actgtagtc ggccatgtc cat | 1292 | ACT GTA GTC GGC CAT GTC CAT | LEPGEKPYKCPECGKSFSTSGNL TEHQRTHTGEKPYKCPECGKSFS DPGALVRHQRTHTGEKPYKCPEC GKSFSTSGNLTEHQRTHTGEKPY KCPECGKSFSDPGHLVRHQRTHT GEKPYKCPECGKSFSDPGALVRH QRTHTGEKPYKCPECGKSFSQSS SLVRHQRTHTGEKPYKCPECGKS FSTHLDLIRHQRTHTGEKPTGKK TS | 1841 | $X_1X_2X_3X_4X_5X_6X_7X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}DPGALVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRH X_{17}X_{18}X_{19}HX_{20}X_{21}X_{22}X_{23}X_{24}X_8X_9CX_{10}X_{11}CX_{12}X_{13}X_{14}X_{15}X_{16}DPGALV RHX_{17}X_{18}X_{19}HX_{20}X_{21}X_{22}X_{23}X_{24}X_8X_9CX_{10}X_{11}CX_{12}X_{13}X_{14}X_{15}X_{16}QSSS LVRHX_{17}X_{18}X_{19}HX_{20}X_{21}X_{22}X_{23}X_{24}X_8X_9CX_{10}X_{11}CX_{12}X_{13}X_{14}X_{15}X_{16}TH LDLIRHX_{17}X_{18}X_{19}HX_{20}X_{21}X_{22}X_{23}X_{24}X_{25}X_{26}X_{27}X_{28}X_{29}X_{30}$ | 2390 |
| gtagtcggc catgtccat gtc | 1293 | GTA GTC GGC CAT GTC CAT GTC | LEPGEKPYKCPECGKSFSDPGAL VRHQRTHTGEKPYKCPECGKSFS TSGNLTEHQRTHTGEKPYKCPEC GKSFSDPGALVRHQRTHTGEKPY KCPECGKSFSTSGNLTEHQRTHT GEKPYKCPECGKSFSDPGHLVRH QRTHTGEKPYKCPECGKSFSDPG ALVRHQRTHTGEKPYKCPECGKS FSQSSSLVRHQRTHTGEKPTGKK TS | 1842 | $X_1X_2X_3X_4X_5X_6X_7X_8X_9CX_{10}X_{11}CX_{12}X_{13}X_{14}X_{15}X_{16}DPGALVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}DPGALVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLTEH X_{17}X_{18}X_{19}HX_{20}X_{21}X_{22}X_{23}X_{24}X_8X_9CX_{10}X_{11}CX_{12}X_{13}X_{14}X_{15}X_{16}DPGHLV RHX_{17}X_{18}X_{19}HX_{20}X_{21}X_{22}X_{23}X_{24}X_8X_9CX_{10}X_{11}CX_{12}X_{13}X_{14}X_{15}X_{16}DPGA LVRHX_{17}X_{18}X_{19}HX_{20}X_{21}X_{22}X_{23}X_{24}X_8X_9CX_{10}X_{11}CX_{12}X_{13}X_{14}X_{15}X_{16}QS SSLVRHX_{17}X_{18}X_{19}HX_{20}X_{21}X_{22}X_{23}X_{24}X_{25}X_{26}X_{27}X_{28}X_{29}X_{30}$ | 2391 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gtcggccat gtccatgtc gac | 1294 | GTC GGC CAT GTC CAT GTC GAC | LEPGEKPYKCPECGKSFSDPGNL VRHQRTHTGEKPYKCPECGKSFS DPGALVRHQRTHTGEKPYKCPEC GKSFSTSGNLTEHQRTHTGEKPY KCPECGKSFSDPGALVRHQRTHT GEKPYKCPECGKSFSTSGNLTEH QRTHTGEKPYKCPECGKSFSDPG HLVRHQRTHTGEKPYKCPECGKS FSDPGALVRHQRTHTGEKPTGKK TS | 1843 | $X_1X_2X_3X_4X_5X_6X_7X_8X_9CX_{10}X_{11}CX_{12}X_{13}X_{14}X_{15}X_{16}DPGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}DPGALVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}DPGALVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}DPGALVRHX_{17}X_{18}X_{19}HX_{20}X_{21}X_{22}X_{23}X_{24}X_{25}X_{26}X_{27}X_{28}X_{29}X_{30}$ | 2392 |
| ggcatgtc catgtcgac gag | 1295 | GGC CAT GTC GTC GAC GAG | LEPGEKPYKCPECGKSFSRSDNL VRHQRTHTGEKPYKCPECGKSFS DPGNLVRHQRTHTGEKPYKCPEC GKSFSTSDPGALVRHQRTHTGEKPY KCPECGKSFSTSGNLTEHQRTHT GEKPYKCPECGKSFSDPGALVRH QRTHTGEKPYKCPECGKSFSTSG NLTEHQRTHTGEKPYKCPECGKS FSDPGHLVRHQRTHTGEKPTGKK TS | 1844 | $X_1X_2X_3X_4X_5X_6X_7X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}DPGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}DPGALVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}DPGALVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_{25}X_{26}X_{27}X_{28}X_{29}X_{30}$ | 2393 |
| catgtccat gtcgacgag ggt | 1296 | CAT GTC CAT GTC GAC GAG GGT | LEPGEKPYKCPECGKSFSTSGHL VRHQRTHTGEKPYKCPECGKSFS RSDNLVRHQRTHTGEKPYKCPEC GKSFSDPGNLVRHQRTHTGEKPY KCPECGKSFSDPGALVRHQRTHT GEKPYKCPECGKSFSTSGNLTEH QRTHTGEKPYKCPECGKSFSDPG ALVRHQRTHTGEKPYKCPECGKS FSTSGNLTEHQRTHTGEKPTGKK TS | 1845 | $X_1X_2X_3X_4X_5X_6X_7X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}DPGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}DPGALVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}DPGALVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_{25}X_{26}X_{27}X_{28}X_{29}X_{30}$ | 2394 |
| ctgcctcca cgccggtc cac | 1297 | CTG CCT CCA CGC GGC CAC | LEPGEKPYKCPECGKSFSSKKAL TEHQRTHTGEKPYKCPECGKSFS DPGHLVRHQRTHGLLEHQRTHT GKSFSHTGHLLEHQRTHTGEKPY KCPECGKSFSHTGHLLEHQRTHT GEKPYKCPECGKSFSTSHSLTEH QRTHTGEKPYKCPECGKSFSTKN SLTEHQRTHTGEKPYKCPECGKS FSRNDALTEHQRTHTGEKPTGKK TS | 1846 | $X_1X_2X_3X_4X_5X_6X_7X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}HTGHLLEHX_{17}X_{18}X_{19}HX_{20}X_{21}X_{22}X_{23}X_{24}X_8X_9CX_{10}X_{11}CX_{12}X_{13}X_{14}X_{15}X_{16}HTGHLLEHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_{25}X_{26}X_{27}X_{28}X_{29}X_{30}$ | 2395 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| cctccacgc cgcggccac ctg | 1298 | CCT CCA CGC CGC GGC CAC CTG | LEPGEKPYKCPECGKSFSRNDAL TEHQRTHTGEKPYKCPECGKSFS SKKALTEHQRTHTGEKPYKCPEC GKSFSDPGHLVRHQRTHTGEKPY KCPECGKSFSHTGHLLEHQRTHT GEKPYKCPECGKSFSHTGHLLEH QRTHTGEKPYKCPECGKSFSTSH SLTEHQRTHTGEKPYKCPECGKS FSTKNSLTEHQRTHTGEKPTGKK TS | 1847 | $X_1X_2X_3X_4X_5X_6X_7X_8X_9CX_{10}X_{11}CX_{12}X_{13}X_{14}X_{15}X_{16}RNDALTEHX_{17}X_{18}X_{19}$ $HX_{20}X_{21}X_{22}X_{23}X_{24}X_8X_9CX_{10}X_{11}CX_{12}X_{13}X_{14}X_{15}X_{16}SKKALTEHX_{17}X_{18}$ $X_{19}HX_{20}X_{21}X_{22}X_{23}X_{24}X_8X_9CX_{10}X_{11}CX_{12}X_{13}X_{14}X_{15}X_{16}DPGHLVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}HTGHLLEH$ $X_{17}X_{18}X_{19}HX_{20}X_{21}X_{22}X_{23}X_{24}X_8X_9CX_{10}X_{11}CX_{12}X_{13}X_{14}X_{15}X_{16}HTGHLL$ $EHX_{17}X_{18}X_{19}HX_{20}X_{21}X_{22}X_{23}X_{24}X_8X_9CX_{10}X_{11}CX_{12}X_{13}X_{14}X_{15}X_{16}TSHS$ $LTEHX_{17}X_{18}X_{19}HX_{20}X_{21}X_{22}X_{23}X_{24}X_8X_9CX_{10}X_{11}CX_{12}XEX_{14}X_{15}X_{16}TK$ $NSLTEHX_{17}X_{18}X_{19}HX_{20}X_{21}X_{22}X_{23}X_{24}X_{25}X_{26}X_{27}X_{28}X_{29}X_{30}$ | 2396 |
| ccacgccgc ggccacctg ccc | 1299 | CCA CGC CGC CAC CTG CCC | LEPGEKPYKCPECGKSFSSKKHL AEHQRTHTGEKPYKCPECGKSFS RNDALTEHQRTHTGEKPYKCPEC GKSFSSKKALTEHQRTHTGEKPY KCPECGKSFSDPGHLVRHQRTHT GEKPYKCPECGKSFSHTGHLLEH QRTHTGEKPYKCPECGKSFSHTG HLLEHQRTHTGEKPYKCPECGKS FSTSHSLTEHQRTHTGEKPTGKK TS | 1848 | $X_1X_2X_3X_4X_5X_6X_7X_8X_9CX_{10}X_{11}CX_{12}X_{13}X_{14}X_{15}X_{16}SKKHLAEHX_{17}X_{18}X_{19}$ $HX_{20}X_{21}X_{22}X_{23}X_{24}X_8X_9CX_{10}X_{11}CX_{12}X_{13}X_{14}X_{15}X_{16}RNDALTEHX_{17}X_{18}$ $X_{19}HX_{20}X_{21}X_{22}X_{23}X_{24}X_8X_9CX_{10}X_{11}CX_{12}X_{13}X_{14}X_{15}X_{16}SKKALTEHX_{17}$ $X_{18}X_{19}HX_{20}X_{21}X_{22}X_{23}X_{24}X_8X_9CX_{10}X_{11}CX_{12}X_{13}X_{14}X_{15}X_{16}DPGHLVRH$ $X_{17}X_{18}X_{19}HX_{20}X_{21}X_{22}X_{23}X_{24}X_8X_9CX_{10}X_{11}CX_{12}X_{13}X_{14}X_{15}X_{16}HTGHLL$ $EHX_{17}X_{18}X_{19}HX_{20}X_{21}X_{22}X_{23}X_{24}X_8X_9CX_{10}X_{11}CX_{12}X_{13}X_{14}X_{15}X_{16}HTGH$ $LLEHX_{17}X_{18}X_{19}HX_{20}X_{21}X_{22}X_{23}X_{24}X_8X_9CX_{10}X_{11}CX_{12}X_{13}X_{14}X_{15}X_{16}TS$ $HSLTEHX_{17}X_{18}X_{19}HX_{20}X_{21}X_{22}X_{23}X_{24}X_{25}X_{26}X_{27}X_{28}X_{29}X_{30}$ | 2397 |
| cggccacct gccctaccc tgg | 1300 | CGG CCA CCT GCC CTA CCC TGG | LEPGEKPYKCPECGKSFSRSDHL TTHQRTHTGEKPYKCPECGKSFS SKKHLAEHQRTHTGEKPYKCPEC GKSFSQNSTLTEHQRTHTGEKPY KCPECGKSFSDCRDLARHQRTHT GEKPYKCPECGKSFSTKNSLTEH QRTHTGEKPYKCPECGKSFSTSH SLTEHQRTHTGEKPYKCPECGKS FSRSDKLTEHQRTHTGEKPTGKK TS | 1849 | $X_1X_2X_3X_4X_5X_6X_7X_8X_9CX_{10}X_{11}CX_{12}X_{13}X_{14}X_{15}X_{16}RSDHLTTHX_{17}X_{18}X_{19}$ $HX_{20}X_{21}X_{22}X_{23}X_{24}X_8X_9CX_{10}X_{11}CX_{12}X_{13}X_{14}X_{15}X_{16}SKKHLAEHX_{17}X_{18}$ $X_{19}HX_{20}X_{21}X_{22}X_{23}X_{24}X_8X_9CX_{10}X_{11}CX_{12}X_{13}X_{14}X_{15}X_{16}QNSTLTEHX_{17}$ $X_{18}X_{19}HX_{20}X_{21}X_{22}X_{23}X_{24}X_8X_9CX_{10}X_{11}CX_{12}X_{13}X_{14}X_{15}X_{16}DCRDLARH$ $X_{17}X_{18}X_{19}HX_{20}X_{21}X_{22}X_{23}X_{24}X_8X_9CX_{10}X_{11}CX_{12}X_{13}X_{14}X_{15}X_{16}TKNSLT$ $EHX_{17}X_{18}X_{19}HX_{20}X_{21}X_{22}X_{23}X_{24}X_8X_9CX_{10}X_{11}CX_{12}X_{13}X_{14}X_{15}X_{16}TSHS$ $LTEHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DKLTEHX_{17}X_{18}X_{19}HX_{20}X_{21}X_{22}X_{23}X_{24}X_{25}X_{26}X_{27}X_{28}X_{29}X_{30}$ | 2398 |
| acgccgcgg ccacctgcc cta | 1301 | ACG CCG CGG CCA CCT GCC CTA | LEPGEKPYKCPECGKSFSQNSTL TEHQRTHTGEKPYKCPECGKSFS DCRDLARHQRTHTGEKPYKCPEC GKSFSTKNSLTEHQRTHTGEKPY KCPECGKSFSTSHSLTEHQRTHT GEKPYKCPECGKSFSRSDKLTEH QRTHTGEKPYKCPECGKSFSRND TLTEHQRTHTGEKPYKCPECGKS FSRTDTLRDHQRTHTGEKPTGKK TS | 1850 | $X_1X_2X_3X_4X_5X_6X_7X_8X_9CX_{10}X_{11}CX_{12}X_{13}X_{14}X_{15}X_{16}QNSTLTEHX_{17}X_{18}X_{19}$ $HX_{20}X_{21}X_{22}X_{23}X_{24}X_8X_9CX_{10}X_{11}CX_{12}X_{13}X_{14}X_{15}X_{16}DCRDLARHX_{17}X_{18}$ $X_{19}HX_{20}X_{21}X_{22}X_{23}X_{24}X_8X_9CX_{10}X_{11}CX_{12}X_{13}X_{14}X_{15}X_{16}TKNSLTEHX_{17}$ $X_{18}X_{19}HX_{20}X_{21}X_{22}X_{23}X_{24}X_8X_9CX_{10}X_{11}CX_{12}X_{13}X_{14}X_{15}X_{16}TSHSLTEH$ $X_{17}X_{18}X_{19}HX_{20}X_{21}X_{22}X_{23}X_{24}X_8X_9CX_{10}X_{11}CX_{12}X_{13}X_{14}X_{15}X_{16}RSDKLT$ $EHX_{17}X_{18}X_{19}HX_{20}X_{21}X_{22}X_{23}X_{24}X_8X_9CX_{10}X_{11}CX_{12}X_{13}X_{14}X_{15}X_{16}RNDT$ $LTEHX_{17}X_{18}X_{19}HX_{20}X_{21}X_{22}X_{23}X_{24}X_8X_9CX_{10}X_{11}CX_{12}X_{13}X_{14}X_{15}X_{16}RT$ $DTLRDHX_{17}X_{18}X_{19}HX_{20}X_{21}X_{22}X_{23}X_{24}X_{25}X_{26}X_{27}X_{28}X_{29}X_{30}$ | 2399 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| ccgggccca cctgcccta ccc | 1302 | CCG CGG CCA CCT GCC CTA CCC | LEPGEKPYKCPECGKSFSSKKHL AEHQRTHTGEKPYKCPECGKSFS QNSTLTEHQRTHTGEKPYKCPEC GKSFSDCRDLARHQRTHTGEKPY KCPECGKSFSTKNSLTEHQRTHT GEKPYKCPECGKSFSTSHSLTEH QRTHTGEKPYKCPECGKSFSRSD KLTEHQRTHTGEKPYKCPECGKS FSRNDTLTEHQRTHTGEKPTGKK TS | 1851 | $X_1X_2X_3X_4X_5X_6X_7X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}QNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}TKNSLTEH X_{17}X_{18}X_{19}HX_{20}X_{21}X_{22}X_{23}X_{24}X_8X_9CX_{10}X_{11}CX_{12}X_{13}X_{14}X_{15}X_{16}TSHSLT EHX_{17}X_{18}X_{19}HX_{20}X_{21}X_{22}X_{23}X_{24}X_8X_9CX_{10}X_{11}CX_{12}X_{13}X_{14}X_{15}X_{16}RSDK LTEHX_{17}X_{18}X_{19}HX_{20}X_{21}X_{22}X_{23}X_{24}X_8X_9CX_{10}X_{11}CX_{12}X_{13}X_{14}X_{15}X_{16}RN DTLTEHX_{17}X_{18}X_{19}HX_{20}X_{21}X_{22}X_{23}X_{24}X_{25}X_{26}X_{27}X_{28}X_{29}X_{30}$ | 2400 |
| ccacctgcc ctaccctgg gcg | 1303 | CCA CCT GCC CTA CCC TGG GCG | LEPGEKPYKCPECGKSFSRSDDL VRHQRTHTGEKPYKCPECGKSFS RSDHLTTHQRTHTGEKPYKCPEC GKSFSSKKHLAEHQRTHTGEKPY KCPECGKSFSQNSTLTEHQRTHT GEKPYKCPECGKSFSDCRDLARH QRTHTGEKPYKCPECGKSFSTKN SLTEHQRTHTGEKPYKCPECGKS FSTSHSLTEHQRTHTGEKPTGKK TS | 1852 | $X_1X_2X_3X_4X_5X_6X_7X_8X_9CX_{10}X_{11}CX_{12}X_{13}X_{14}X_{15}X_{16}RSDDLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}QNSTLTEH X_{17}X_{18}X_{19}HX_{20}X_{21}X_{22}X_{23}X_{24}X_8X_9CX_{10}X_{11}CX_{12}X_{13}X_{14}X_{15}X_{16}DCRDLA RHX_{17}X_{18}X_{19}HX_{20}X_{21}X_{22}X_{23}X_{24}X_8X_9CX_{10}X_{11}CX_{12}X_{13}X_{14}X_{15}X_{16}TKNS LTEHX_{17}X_{18}X_{19}HX_{20}X_{21}X_{22}X_{23}X_{24}X_8X_9CX_{10}X_{11}CX_{12}X_{13}X_{14}X_{15}X_{16}TS HSLTEHX_{17}X_{18}X_{19}HX_{20}X_{21}X_{22}X_{23}X_{24}X_{25}X_{26}X_{27}X_{28}X_{29}X_{30}$ | 2401 |
| cctgcccta ccctgggcg ccc | 1304 | CCT GCC CTA CCC TGG gcg CCC | LEPGEKPYKCPECGKSFSSKKHL AEHQRTHTGEKPYKCPECGKSFS RSDDLVRHQRTHTGEKPYKCPEC GKSFSRSDHLTTHQRTHTGEKPY KCPECGKSFSSKKHLAEHQRTHT GEKPYKCPECGKSFSQNSTLTEH QRTHTGEKPYKCPECGKSFSDCR DLARHQRTHTGEKPYKCPECGKS FSTKNSLTEHQRTHTGEKPTGKK TS | 1853 | $X_1X_2X_3X_4X_5X_6X_7X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}RSDDLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEH X_{17}X_{18}X_{19}HX_{20}X_{21}X_{22}X_{23}X_{24}X_8X_9CX_{10}X_{11}CX_{12}X_{13}X_{14}X_{15}X_{16}QNSTLT EHX_{17}X_{18}X_{19}HX_{20}X_{21}X_{22}X_{23}X_{24}X_8X_9CX_{10}X_{11}CX_{12}X_{13}X_{14}X_{15}X_{16}DCRD LARHX_{17}X_{18}X_{19}HX_{20}X_{21}X_{22}X_{23}X_{24}X_8X_9CX_{10}X_{11}CX_{12}X_{13}X_{14}X_{15}X_{16}TK NSLTEHX_{17}X_{18}X_{19}HX_{20}X_{21}X_{22}X_{23}X_{24}X_{25}X_{26}X_{27}X_{28}X_{29}X_{30}$ | 2402 |
| gccctaccc tgggcgccc acc | 1305 | GCC CTA CCC TGG gcg CCC ACC | LEPGEKPYKCPECGKSFSDKKDL TRHQRTHTGEKPYKCPECGKSFS SKKHLAEHQRTHTGEKPYKCPEC GKSFSRSDDLVRHQRTHTGEKPY KCPECGKSFSRSDHLTTHQRTHT GEKPYKCPECGKSFSSKKHLAEH QRTHTGEKPYKCPECGKSFSQNS TLTEHQRTHTGEKPYKCPECGKS FSDCRDLARHQRTHTGEKPTGKK TS | 1854 | $X_1X_2X_3X_4X_5X_6X_7X_8X_9CX_{10}X_{11}CX_{12}X_{13}X_{14}X_{15}X_{16}DKKDLTRHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}RSDDLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTH X_{17}X_{18}X_{19}HX_{20}X_{21}X_{22}X_{23}X_{24}X_8X_9CX_{10}X_{11}CX_{12}X_{13}X_{14}X_{15}X_{16}SKKHLA EHX_{17}X_{18}X_{19}HX_{20}X_{21}X_{22}X_{23}X_{24}X_8X_9CX_{10}X_{11}CX_{12}X_{13}X_{14}X_{15}X_{16}QNST LTEHX_{17}X_{18}X_{19}HX_{20}X_{21}X_{22}X_{23}X_{24}X_8X_9CX_{10}X_{11}CX_{12}X_{13}X_{14}X_{15}X_{16}DC RDLARHX_{17}X_{18}X_{19}HX_{20}X_{21}X_{22}X_{23}X_{24}X_{25}X_{26}X_{27}X_{28}X_{29}X_{30}$ | 2403 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| ccctgggcg cccacccg aag | 1306 | CCC TGG gcg ACC CCG AAG | LEPGEKPYKCPECGKSFSRKDNL KNHQRTHTGEKPYKCPECGKSFS RNDTLTEHQRTHTGEKPYKCPEC GKSFSDKKDLTRHQRTHTGEKPY KCPECGKSFSSKKHLAEHQRTHT GEKPYKCPECGKSFSRDDLVRH QRTHTGEKPYKCPECGKSFSRSD HLTTHQRTHTGEKPYKCPECGKS FSSKKHLAEHQRTHTGEKPTGKK TS | 1855 | $X_1X_2X_3X_4X_5X_6X_7X_8X_9CX_{10}X_{11}CX_{12}X_{13}X_{14}X_{15}X_{16}RKDNLKNHX_{17}X_{18}X_{19}HX_{20}X20X_{21}X_{22}X_{23}X_{24}X_8X_9CX_{10}X_{11}CX_{12}X_{13}X_{14}X_{15}X_{16}RNDTLTEHX_{17}X_{18}X_{19}HX_{20}X_{21}X_{22}X_{23}X_{24}X_8X_9CX_{10}X_{11}CX_{12}X_{13}X_{14}X_{15}X_{16}DKKDLTRHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEH X_{17}X_{18}X_{19}HX_{20}X_{21}X_{22}X_{23}X_{24}X_8X_9CX_{10}X_{11}CX_{12}X_{13}X_{14}X_{15}X_{16}RSDDLV RHX_{17}X_{18}X_{19}HX_{20}X_{21}X_{22}X_{23}X_{24}X_8X_9CX_{10}X_{11}CX_{12}X_{13}X_{14}X_{15}X_{16}RSDH LTTHX_{17}X_{18}X_{19}HX_{20}X_{21}X_{22}X_{23}X_{24}X_8X_9CX_{10}X_{11}CX_{12}XEX_{14}X_{15}X_{16}SK KHLAEHX_{17}X_{18}X_{19}HX_{20}X_{21}X_{22}X_{23}X_{24}X_{25}X_{26}X_{27}X_{28}X_{29}X_{30}$ | 2404 |
| tgggcgccc acccgaag gcc | 1307 | TGG gcg CCC ACC CCG AAG GCC | LEPGEKPYKCPECGKSFSDCRDL ARHQRTHTGEKPYKCPECGKSFS RKDNLKNHQRTHTGEKPYKCPEC GKSFSRNDTLTEHQRTHTGEKPY KCPECGKSFSDKKDLTRHQRTHT GEKPYKCPECGKSFSSKKHLAEH QRTHTGEKPYKCPECGKSFSRSD DLVRHQRTHTGEKPYKCPECGKS FSRSDHLTTHQRTHTGEKPTGKK TS | 1856 | $X_1X_2X_3X_4X_5X_6X_7X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}RKDNLKNHX_{17}X_{18}X_{19}HX_{20}X_{21}X_{22}X_{23}X_{24}X_8X_9CX_{10}X_{11}CX_{12}X_{13}X_{14}X_{15}X_{16}RNDTLTEHX_{17}X_{18}X_{19}HX_{20}X_{21}X_{22}X_{23}X_{24}X_8X_9CX_{10}X_{11}CX_{12}X_{13}X_{14}X_{15}X_{16}DKKDLTRHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLA EHX_{17}X_{18}X_{19}HX_{20}X_{21}X_{22}X_{23}X_{24}X_8X_9CX_{10}X_{11}CX_{12}X_{13}X_{14}X_{15}X_{16}RSDD LVRHX_{17}X_{18}X_{19}HX_{20}X_{21}X_{22}X_{23}X_{24}X_8X_9CX_{10}X_{11}CX_{12}X_{13}X_{14}X_{15}X_{16}RS DHLTTHX_{17}X_{18}X_{19}HX_{20}X_{21}X_{22}X_{23}X_{24}X_{25}X_{26}X_{27}X_{28}X_{29}X_{30}$ | 2405 |
| ctaccctgg gcgcccacc ccg | 1308 | CTA CCC TGG gcg CCC ACC CCG | LEPGEKPYKCPECGKSFSRNDTL TEHQRTHTGEKPYKCPECGKSFS DKKDLTRHQRTHTGEKPYKCPEC GKSFSSKKHLAEHQRTHTGEKPY KCPECGKSFSRDDLVRHQRTHTG GEKPYKCPECGKSFSRSDHLTTH QRTHTGEKPYKCPECGKSFSSKK HLAEHQRTHTGEKPYKCPECGKS FSQNSTLTEHQRTHTGEKPTGKK TS | 1857 | $X_1X_2X_3X_4X_5X_6X_7X_8X_9CX_{10}X_{11}CX_{12}X_{13}X_{14}X_{15}X_{16}RNDTLTEHX_{17}X_{18}X_{19}HX_{20}X_{21}X_{22}X_{23}X_{24}X_8X_9CX_{10}X_{11}CX_{12}X_{13}X_{14}X_{15}X_{16}DKKDLTRHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}RSDDLVRH X_{17}X_{18}X_{19}HX_{20}X_{21}X_{22}X_{23}X_{24}X_8X_9CX_{10}X_{11}CX_{12}X_{13}X_{14}X_{15}X_{16}RSDHLT THX_{17}X_{18}X_{19}HX_{20}X_{21}X_{22}X_{23}X_{24}X_8X_9CX_{10}X_{11}CX_{12}X_{13}X_{14}X_{15}X_{16}SKKH LAEHX_{17}X_{18}X_{19}HX_{20}X_{21}X_{22}X_{23}X_{24}X_8X_9CX_{10}X_{11}CX_{12}X_{13}X_{14}X_{15}X_{16}QN STLTEHX_{17}X_{18}X_{19}HX_{20}X_{21}X_{22}X_{23}X_{24}X_{25}X_{26}X_{27}X_{28}X_{29}X_{30}$ | 2406 |
| cccaccccg aaggccccc gcc | 1309 | CCC ACC CCG AAG GCC CCC GCC | LEPGEKPYKCPECGKSFSDCRDL ARHQRTHTGEKPYKCPECGKSFS SKKHLAEHQRTHTGEKPYKCPEC GKSFSDCRDLARHQRTHTGEKPY KCPECGKSFSRKDNLKNHQRTHT GEKPYKCPECGKSFSRNDTLTEH QRTHTGEKPYKCPECGKSFSDKK DLTRHQRTHTGEKPYKCPECGKS FSSKKHLAEHQRTHTGEKPTGKK TS | 1858 | $X_1X_2X_3X_4X_5X_6X_7X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}RKDNLKNH X_{17}X_{18}X_{19}HX_{20}X_{21}X_{22}X_{23}X_{24}X_8X_9CX_{10}X_{11}CX_{12}X_{13}X_{14}X_{15}X_{16}RNDTLT EHX_{17}X_{18}X_{19}HX_{20}X_{21}X_{22}X_{23}X_{24}X_8X_9CX_{10}X_{11}CX_{12}X_{13}X_{14}X_{15}X_{16}DKKD LTRHX_{17}X_{18}X_{19}HX_{20}X_{21}X_{22}X_{23}X_{24}X_8X_9CX_{10}X_{11}CX_{12}X_{13}X_{14}X_{15}X_{16}SK KHLAEHX_{17}X_{18}X_{19}HX_{20}X_{21}X_{22}X_{23}X_{24}X_{25}X_{26}X_{27}X_{28}X_{29}X_{30}$ | 2407 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gcgcccacc ccgaaggcc ccc | 1310 | gcg CCC ACC CCG AAG GCC CCC | LEPGEKPYKCPECGKSFSSKKHL AEHQRTHTGEKPYKCPECGKSFS DCRDLARHQRTHTGEKPYKCPEC GKSFSRKDNLKNHQRTHTGEKPY KCPECGKSFSRNDTLTEHQRTHT GEKPYKCPECGKSFSDKKDLTRH QRTHTGEKPYKCPECGKSFSSKK HLAEHQRTHTGEKPYKCPECGKS FSRSDDLVRHQRTHTGEKPTGKK TS | 1859 | $X_1X_2X_3X_4X_5X_6X_7X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}RKDNLKNHX_{17}X_{18}X_{19}HX_{20}X_{21}X_{22}X_{23}X_{24}X_8X_9CX_{10}X_{11}CX_{12}X_{13}X_{14}X_{15}X_{16}RNDTLTEH X_{17}X_{18}X_{19}HX_{20}X_{21}X_{22}X_{23}X_{24}X_8X_9CX_{10}X_{11}CX_{12}X_{13}X_{14}X_{15}X_{16}DKKDLT RHX_{17}X_{18}X_{19}HX_{20}X_{21}X_{22}X_{23}X_{24}X_8X_9CX_{10}X_{11}CX_{12}X_{13}X_{14}X_{15}X_{16}SKKH LAEHX_{17}X_{18}X_{19}HX_{20}X_{21}X_{22}X_{23}X_{24}X_8X_9CX_{10}X_{11}CX_{12}X_{13}X_{14}X_{15}X_{16}RS DDLVRHX_{17}X_{18}X_{19}HX_{20}X_{21}X_{22}X_{23}X_{24}X_{25}X_{26}X_{27}X_{28}X_{29}X_{30}$ | 2408 |
| cctaccctg ggcgcccac ccc | 1311 | CCT ACC CTG GGC GCC CAC CCC | LEPGEKPYKCPECGKSFSSKKHL AEHQRTHTGEKPYKCPECGKSFS SKKALTEHQRTHTGEKPYKCPEC GKSFSDCRDLARHQRTHTGEKPY KCPECGKSFSDPGHLVRHQRTHT GEKPYKCPECGKSFSRNDALTEH QRTHTGEKPYKCPECGKSFSDKK DLTRHQRTHTGEKPYKCPECGKS FSTKNSLTEHQRTHTGEKPTGKK TS | 1860 | $X_1X_2X_3X_4X_5X_6X_7X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRH X_{17}X_{18}X_{19}HX_{20}X_{21}X_{22}X_{23}X_{24}X_8X_9CX_{10}X_{11}CX_{12}X_{13}X_{14}X_{15}X_{16}RNDALT EHX_{17}X_{18}X_{19}HX_{20}X_{21}X_{22}X_{23}X_{24}X_8X_9CX_{10}X_{11}CX_{12}X_{13}X_{14}X_{15}X_{16}DKKD LTRHX_{17}X_{18}X_{19}HX_{20}X_{21}X_{22}X_{23}X_{24}X_8X_9CX_{10}X_{11}CX_{12}X_{13}X_{14}X_{15}X_{16}TK NSLTEHX_{17}X_{18}X_{19}HX_{20}X_{21}X_{22}X_{23}X_{24}X_{25}X_{26}X_{27}X_{28}X_{29}X_{30}$ | 2409 |
| ctggcgcc caccccgaa ggc | 1312 | CTG GCC GCC CAC CCC GAA GGC | LEPGEKPYKCPECGKSFSDPGHL VRHQRTHTGEKPYKCPECGKSFS QSSNLVRHQRTHTGEKPYKCPEC GKSFSSKKHLAEHQRTHTGEKPY KCPECGKSFSSKKALTEHQRTHT GEKPYKCPECGKSFSDCRDLARH QRTHTGEKPYKCPECGKSFSDPG HLVRHQRTHTGEKPYKCPECGKS FSRNDALTEHQRTHTGEKPTGKK TS | 1861 | $X_1X_2X_3X_4X_5X_6X_7X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSSNLVRHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEH X_{17}X_{18}X_{19}HX_{20}X_{21}X_{22}X_{23}X_{24}X_8X_9CX_{10}X_{11}CX_{12}X_{13}X_{14}X_{15}X_{16}DCRDLA RHX_{17}X_{18}X_{19}HX_{20}X_{21}X_{22}X_{23}X_{24}X_8X_9CX_{10}X_{11}CX_{12}X_{13}X_{14}X_{15}X_{16}DPGH LVRHX_{17}X_{18}X_{19}HX_{20}X_{21}X_{22}X_{23}X_{24}X_8X_9CX_{10}X_{11}CX_{12}XEX_{14}X_{15}X_{16}RN DALTEHX_{17}X_{18}X_{19}HX_{20}X_{21}X_{22}X_{23}X_{24}X_{25}X_{26}X_{27}X_{28}X_{29}X_{30}$ | 2410 |
| acctgggc gccaccccc gaa | 106 | ACC CTG GGC GCC CAC CCC GAA | LEPGEKPYKCPECGKSFSQSSNL VRHQRTHTGEKPYKCPECGKSFS SKKHLAEHQRTHTGEKPYKCPEC GKSFSSKKALTEHQRTHTGEKPY KCPECGKSFSDCRDLARHQRTHT GEKPYKCPECGKSFSDPGHLVRH QRTHTGEKPYKCPECGKSFSRND ALTEHQRTHTGEKPYKCPECGKS FSDKKDLTRHQRTHTGEKPTGKK TS | 107 | $X_1X_2X_3X_4X_5X_6X_7X_8X_9CX_{10}X_{11}CX_{12}X_{13}X_{14}X_{15}X_{16}QSSNLVRHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARH X_{17}X_{18}X_{19}HX_{20}X_{21}X_{22}X_{23}X_{24}X_8X_9CX_{10}X_{11}CX_{12}X_{13}X_{14}X_{15}X_{16}DPGHLV RHX_{17}X_{18}X_{19}HX_{20}X_{21}X_{22}X_{23}X_{24}X_8X_9CX_{10}X_{11}CX_{12}X_{13}X_{14}X_{15}X_{16}RNDA LTEHX_{17}X_{18}X_{19}HX_{20}X_{21}X_{22}X_{23}X_{24}X_8X_9CX_{10}X_{11}CX_{12}X_{13}X_{14}X_{15}X_{16}DK KDLTRHX_{17}X_{18}X_{19}HX_{20}X_{21}X_{22}X_{23}X_{24}X_{25}X_{26}X_{27}X_{28}X_{29}X_{30}$ | 314 |

TABLE 10-continued

| Column 1 Nucleotide Sequence of Target Site in HNF4α Expression Control Region | Column 2 Target sequence with space | Column 3 Target sequence | Column 4 SEQ ID NO. (corresponds to sequences in Columns 1 and 3) | Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|---|
| ggcgcccac cccgaaggc ccc | GGC GCC CAC CCC GAA GGC CCC | | 1313 | LEPGEKPYKCPECGKSFSKKHL AEHQRTHTGEKPYKCPECGKSFS DPGHLVRHQRTHTGEKPYKCPEC GKSFSQSSNLVRHQRTHTGEKPY KCPECGKSFSSKKHLAEHQRTHT GEKPYKCPECGKSFSSKKALTEH QRTHTGEKPYKCPECGKSFSDCR DLARHQRTHTGEKPYKCPECGKS FSDPGHLVRHQRTHTGEKPTGKK TS | 1862 | $X_1X_2X_3X_4X_5X_6X_7X_8X_9CX_{10}X_{11}CX_{12}X_{13}X_{14}X_{15}X_{16}$SKKHLAEH$X_{17}X_{18}X_{19}$ H$X_{20}X_{21}X_{22}X_{23}X_{24}X_8X_9$C$X_{10}X_{11}$C$X_{12}X_{13}X_{14}X_{15}X_{16}$DPGHLVRH$X_{17}X_{18}$ $X_{19}$H$X_{20}X_{21}X_{22}X_{23}X_{24}X_8X_9$C$X_{10}X_{11}$C$X_{12}X_{13}X_{14}X_{15}X_{16}$QSSNLVRH$X_{17}$ $X_{18}X_{19}$H$X_{20}X_{21}X_{22}X_{23}X_{24}X_8X_9$C$X_{10}X_{11}$C$X_{12}X_{13}X_{14}X_{15}X_{16}$SKKHLAEH $X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$SKKALT EH$X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$DCRD LARH$X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$DP GHLVRH$X_{17}X_{18}X_{19}$H$X_{20}X_{21}X_{22}X_{23}X_{24}X_{25}X_{26}X_{27}X_{28}X_{29}X_{30}$ | 2411 |
| caccccgaa ggccccgc cct | CAC CCC GAA GGC CCC CGC CCT | | 1314 | LEPGEKPYKCPECGKSFSTKNSL TEHQRTHTGEKPYKCPECGKSFS HTGHLLEHQRTHTGEKPYKCPEC GKSFSSKKHLAEHQRTHTGEKPY KCPECGKSFSDPGHLVRHQRTHT GEKPYKCPECGKSFSQSSNLVRH QRTHTGEKPYKCPECGKSFSSKK HLAEHQRTHTGEKPYKCPECGKS FSSKKALTEHQRTHTGEKPTGKK TS | 1863 | $X_1X_2X_3X_4X_5X_6X_7X_8X_9$C$X_{10}X_{11}$C$X_{12}X_{13}X_{14}X_{15}X_{16}$TKNSLTEH$X_{17}X_{18}X_{19}$ H$X_{20}X_{21}X_{22}X_{23}X_{24}X_8X_9$C$X_{10}X_{11}$C$X_{12}X_{13}X_{14}X_{15}X_{16}$HTGHLLEH$X_{17}X_{18}$ $X_{19}$H$X_{20}X_{21}X_{22}X_{23}X_{24}X_8X_9$C$X_{10}X_{11}$C$X_{12}X_{13}X_{14}X_{15}X_{16}$SKKHLAEH$X_{17}$ $X_{18}X_{19}$H$X_{20}X_{21}X_{22}X_{23}X_{24}X_8X_9$C$X_{10}X_{11}$C$X_{12}X_{13}X_{14}X_{15}X_{16}$DPGHLVRH $X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$QSSNLV RH$X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$SKKH LAEH$X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$SK KALTEH$X_{17}X_{18}X_{19}$H$X_{20}X_{21}X_{22}X_{23}X_{24}X_{25}X_{26}X_{27}X_{28}X_{29}X_{30}$ | 2412 |
| gcccacccc gaaggcccc cgc | GCC CAC CCC GAA GGC CCC CGC | | 1315 | LEPGEKPYKCPECGKSFSHTGHL LEHQRTHTGEKPYKCPECGKSFS SKKHLAEHQRTHTGEKPYKCPEC GKSFSDPGHLVRHQRTHTGEKPY KCPECGKSFSQSSNLVRHQRTHT GEKPYKCPECGKSFSSKKHLAEH QRTHTGEKPYKCPECGKSFSSKK ALTEHQRTHTGEKPYKCPECGKS FSDCRDLARHQRTHTGEKPTGKK TS | 1864 | $X_1X_2X_3X_4X_5X_6X_7X_8X_9$C$X_{10}X_{11}$C$X_{12}X_{13}X_{14}X_{15}X_{16}$HTGHLLEH$X_{17}X_{18}X_{19}$ H$X_{20}X_{21}X_{22}X_{23}X_{24}X_8X_9$C$X_{10}X_{11}$C$X_{12}X_{13}X_{14}X_{15}X_{16}$SKKHLAEH$X_{17}X_{18}$ $X_{19}$H$X_{20}X_{21}X_{22}X_{23}X_{24}X_8X_9$C$X_{10}X_{11}$C$X_{12}X_{13}X_{14}X_{15}X_{16}$DPGHLVRH$X_{17}$ $X_{18}X_{19}$H$X_{20}X_{21}X_{22}X_{23}X_{24}X_8X_9$C$X_{10}X_{11}$C$X_{12}X_{13}X_{14}X_{15}X_{16}$QSSNLVRH $X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$SKKHLA EH$X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$SKKA LTEH$X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$DC RDLARH$X_{17}X_{18}X_{19}$H$X_{20}X_{21}X_{22}X_{23}X_{24}X_{25}X_{26}X_{27}X_{28}X_{29}X_{30}$ | 2413 |
| cccgaaggc cccgcgcct ccg | CCC GAA GGC CCC CGC CCT CCG | | 1316 | LEPGEKPYKCPECGKSFSRNDTL TEHQRTHTGEKPYKCPECGKSFS TKNSLTEHQRTHGHLLEHQRTHT GKSFSSHTGHLLEHQRTHTGEKPY KCPECGKSFSSKKHLAEHQRTHT GEKPYKCPECGKSFSDPGHLVRH QRTHTGEKPYKCPECGKSFSQSS NLVRHQRTHTGEKPYKCPECGKS FSSKKHLAEHQRTHTGEKPTGKK TS | 1865 | $X_1X_2X_3X_4X_5X_6X_7X_8X_9$C$X_{10}X_{11}$C$X_{12}X_{13}X_{14}X_{15}X_{16}$RNDTLTEH$X_{17}X_{18}X_{19}$ H$X_{20}X_{21}X_{22}X_{23}X_{24}X_8X_9$C$X_{10}X_{11}$C$X_{12}X_{13}X_{14}X_{15}X_{16}$TKNSLTEH$X_{17}X_{18}$ $X_{19}$H$X_{20}X_{21}X_{22}X_{23}X_{24}X_8X_9$C$X_{10}X_{11}$C$X_{12}X_{13}X_{14}X_{15}X_{16}$HTGHLLEH$X_{17}$ $X_{18}X_{19}$H$X_{20}X_{21}X_{22}X_{23}X_{24}X_8X_9$C$X_{10}X_{11}$C$X_{12}X_{13}X_{14}X_{15}X_{16}$SKKHLAEH $X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$DPGHLV RH$X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$QSSN LVRH$X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$SK KHLAEH$X_{17}X_{18}X_{19}$H$X_{20}X_{21}X_{22}X_{23}X_{24}X_{25}X_{26}X_{27}X_{28}X_{29}X_{30}$ | 2414 |

TABLE 10-continued

| Column 1 Nucleotide Sequence of Target Site in HNF4α Expression Control Region | Column 2 Target sequence with space | Column 3 Target sequence | Column 4 SEQ ID NO. (corresponds to sequences in Columns 1 and 3) | Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|---|
| gaaggcccc cgccctccg ccc | GAA GGC CCC CCT CCG CCC | GGC CCT CCG | 1317 | LEPGEKPYKCPECGKSFSSKKHL AEHQRTHTGEKPYKCPECGKSFS RNDTLTEHQRTHTGEKPYKCPEC GKSFSTKNSLTEHQRTHTGEKPY KCPECGKSFSHTGHLLEHQRTHT GEKPYKCPECGKSFSSKKHLAEH QRTHTGEKPYKCPECGKSFSDPG HLVRHQRTHTGEKPYKCPECGKS FSQSSNLVRHQRTHTGEKPTGKK TS | 1866 | $X_1X_2X_3X_4X_5X_6X_7X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}RNDTLTEHX_{17}X_{18}X_{19}HX_{20}X_{21}X_{22}X_{23}X_{24}X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}HTGHLLEHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSSNLVRHX_{17}X_{18}X_{19}HX_{20}X_{21}X_{22}X_{23}X_{24}X_{25}X_{26}X_{27}X_{28}X_{29}X_{30}$ | 2415 |
| cctgggcgc ccacccga agg | CCT ggg CGC CCA CCC CGA AGG | ggg CCA CGA | 1318 | LEPGEKPYKCPECGKSFSRSDHL TNHQRTHTGEKPYKCPECGKSFS QSGHLTEHQRTHTGEKPYKCPEC GKSFSSKKHLAEHQRTHTGEKPY KCPECGKSFSTSHSLTEHQRTHT GEKPYKCPECGKSFSHTGHLLEH QRTHTGEKPYKCPECGKSFSRSD KLVRHQRTHTGEKPYKCPECGKS FSTKNSLTEHQRTHTGEKPTGKK TS | 1867 | $X_1X_2X_3X_4X_5X_6X_7X_8X_9CX_{10}X_{11}CX_{12}X_{13}X_{14}X_{15}X_{16}RSDHLTNHX_{17}X_1BX_{19}HX_{20}X_{21}X_{22}X_{23}X_{24}X_8X_9CX_{10}X_{11}CX_{12}X_{13}X_{14}X_{15}X_{16}QSGHLTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}HTGHLLEHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_{25}X_{26}X_{27}X_{28}X_{29}X_{30}$ | 2416 |
| gggcgccca cccgaagg ccc | ggg CGC CCA CCC CGA AGG CCC | CGC CCC AGG | 1319 | LEPGEKPYKCPECGKSFSSKKHL AEHQRTHTGEKPYKCPECGKSFS RSDHLTNHQRTHTGEKPYKCPEC GKSFSQSGHLTEHQRTHTGEKPY KCPECGKSFSSKKHLAEHQRTHT GEKPYKCPECGKSFSTSHSLTEH QRTHTGEKPYKCPECGKSFSHTG HLLEHQRTHTGEKPYKCPECGKS FSRSDKLVRHQRTHTGEKPTGKK TS | 1868 | $X_1X_2X_3X_4X_5X_6X_7X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}QSGHLTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}HTGHLLEHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_{25}X_{26}X_{27}X_{28}X_{29}X_{30}$ | 2417 |
| cgccacacc cgaaggccc ccg | CGC CCA CCC GAA GGC CCC CCG | CCA CGA CCC | 1320 | LEPGEKPYKCPECGKSFSRNDTL TEHQRTHTGEKPYKCPECGKSFS SKKHLAEHQRTHTGEKPYKCPEC GKSFSRSDHLTNHQRTHTGEKPY KCPECGKSFSQSGHLTEHQRTHT GEKPYKCPECGKSFSSKKHLAEH QRTHTGEKPYKCPECGKSFSTSH SLTEHQRTHTGEKPYKCPECGKS FSHTGHLLEHQRTHTGEKPTGKK TS | 1869 | $X_1X_2X_3X_4X_5X_6X_7X_8X_9CX_{10}X_{11}CX_{12}X_{13}X_{14}X_{15}X_{16}RNDTLTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}QSGHLTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}HTGHLLEHX_{17}X_{18}X_{19}HX_{20}X_{21}X_{22}X_{23}X_{24}X_{25}X_{26}X_{27}X_{28}X_{29}X_{30}$ | 2418 |

TABLE 10-continued

| Column 1 Nucleotide Sequence of Target Site in HNF4α Expression Control Region | Column 2 Target sequence with space | Column 3 Target sequence | Column 4 SEQ ID NO. (corresponds to sequences in Columns 1 and 3) | Column 5 Amino acid Sequence of Zinc Finger DNA Binding Domain Polypeptides Targeting the Target Site in Column 1 | Column 6 SEQ ID NO: | Column 7 Amino Acid Sequence Structure of Zinc Finger DNA Binding Domain Polypeptides Targeting the Target Site in Column 1 (see Table 1B above and description thereof) | SEQ ID NO: |
|---|---|---|---|---|---|---|---|
| ccaccccga aggccccccg ccc | CCA CCC CGA AGG CCC CCG CCC | | 1321 | LEPGEKPYKCPECGKSFSSKKHL AEHQRTHTGEKPYKCPECGKSFS RNDTLTEHQRTHTGEKPYKCPEC GKSFSSKKHLAEHQRTHTGEKPY KCPECGKSFSRSDHLTNHQRTHT GEKPYKCPECGKSFSQSGHLTEH QRTHTGEKPYKCPECGKSFSSKK HLAEHQRTHTGEKPYKCPECGKS FSTSHSLTEHQRTHTGEKPTGKK TS | 1870 | $X_1X_2X_3X_4X_5X_6X_7X_8X_9CX_{10}X_{11}CX_{12}X_{13}X_{14}X_{15}X_{16}$SKKHLAEH$X_{17}X_{18}X_{19}$H$X_{20}X_{21}X_{22}X_{23}X_{24}X_{25}CX_{10}X_{11}CX_{12}X_{13}X_{14}X_{15}X_{16}$RNDTLTEH$X_{17}X_{18}X_{19}HX_{20}X_{21}X_{22}X_{23}X_{24}X_{8}X_{9}CX_{10}X_{11}CX_{12}X_{13}X_{14}X_{15}X_{16}$SKKHLAEH$X_{17}X_{18}X_{19}HX_{20}X_{21}X_{22}X_{23}X_{24}X_{8}X_{9}CX_{10}X_{11}CX_{12}X_{13}X_{14}X_{15}X_{16}$RSDHLTNH$X_{17}X_{18}X_{19}HX_{20}X_{21}X_{22}X_{23}X_{24}X_{8}X_{9}CX_{10}X_{11}CX_{12}X_{13}X_{14}X_{15}X_{16}$QSGHLT EH$X_{17}X_{18}X_{19}HX_{20}X_{21}X_{22}X_{23}X_{24}X_{8}X_{9}CX_{10}X_{11}CX_{12}X_{13}X_{14}X_{15}X_{16}$SKKH LAEH$X_{17}X_{18}X_{19}HX_{20}X_{21}X_{22}X_{23}X_{24}X_{8}X_{9}CX_{10}X_{11}CX_{12}X_{13}X_{14}X_{15}X_{16}$TS HSLTEH$X_{17}X_{13}X_{19}HX_{20}X_{21}X_{22}X_{23}X_{24}X_{25}X_{26}X_{27}X_{28}X_{29}X_{30}$ | 2419 |
| ccactgcct cctcccagt gcc | CCA CTG CCT CCT CCC AGT GCC | | 1322 | LEPGEKPYKCPECGKSFSDCRDL ARHQRTHTGEKPYKCPECGKSFS HRTTLTNHQRTHTGEKPYKCPEC GKSFSSKKHLAEHQRTHTGEKPY KCPECGKSFSTKNSLTEHQRTHT GEKPYKCPECGKSFSTKNSLTEH QRTHTGEKPYKCPECGKSFSRND ALTEHQRTHTGEKPYKCPECGKS FSTSHSLTEHQRTHTGEKPTGKK TS | 1871 | $X_1X_2X_3X_4X_5X_6X_7X_8X_9CX_{10}X_{11}CX_{12}X_{13}X_{14}X_{15}X_{16}$DCRDLARH$X_{17}X_{18}X_{19}HX_{20}X_{21}X_{22}X_{23}X_{24}X_{8}X_{9}CX_{10}X_{11}CX_{12}X_{13}X_{14}X_{15}X_{16}$HRTTLTNH$X_{17}X_{18}X_{19}HX_{20}X_{21}X_{22}X_{23}X_{24}X_{8}X_{9}CX_{10}X_{11}CX_{12}X_{13}X_{14}X_{15}X_{16}$SKKHLAEH$X_{17}X_{18}X_{19}HX_{20}X_{21}X_{22}X_{23}X_{24}X_{8}X_{9}CX_{10}X_{11}CX_{12}X_{13}X_{14}X_{15}X_{16}$TKNSLTEH$X_{17}X_{18}X_{19}HX_{20}X_{21}X_{22}X_{23}X_{24}X_{8}X_{9}CX_{10}X_{11}CX_{12}X_{13}X_{14}X_{15}X_{16}$TKNSLT EH$X_{17}X_{18}X_{19}HX_{20}X_{21}X_{22}X_{23}X_{24}X_{8}X_{9}CX_{10}X_{11}CX_{12}X_{13}X_{14}X_{15}X_{16}$RNDA LTEH$X_{17}X_{18}X_{19}HX_{20}X_{21}X_{22}X_{23}X_{24}X_{8}X_{9}CX_{10}X_{11}CX_{12}X_{13}X_{14}X_{15}X_{16}$TS HSLTEH$X_{17}X_{18}X_{19}HX_{20}X_{21}X_{22}X_{23}X_{24}X_{25}X_{26}X_{27}X_{28}X_{29}X_{30}$ | 2420 |
| tgggaagat ctgctggga gtc | TGG GAA GAT CTG CTG GGA GTC | | 1323 | LEPGEKPYKCPECGKSFSDPGAL VRHQRTHTGEKPYKCPECGKSFS QRAHLERHQRTHTGEKPYKCPEC GKSFSRNDALTEHQRTHTGEKPY KCPECGKSFSRNDALTEHQRTHT GEKPYKCPECGKSFSTSGNLVRH QRTHTGEKPYKCPECGKSFSQSS NLVRHQRTHTGEKPYKCPECGKS FSRSDHLTTHQRTHTGEKPTGKK TS | 1872 | $X_1X_2X_3X_4X_5X_6X_7X_8X_9CX_{10}X_{11}CX_{12}X_{13}X_{14}X_{15}X_{16}$DPGALVRH$X_{17}X_{18}X_{19}HX_{20}X_{21}X_{22}X_{23}X_{24}X_{8}X_{9}CX_{10}X_{11}CX_{12}X_{13}X_{14}X_{15}X_{16}$QRAHLERH$X_{17}X_{18}$X$_{19}HX_{20}X_{21}X_{22}X_{23}X_{24}X_{8}X_{9}CX_{10}X_{11}CX_{12}X_{13}X_{14}X_{15}X_{16}$RNDALTEH$X_{17}X_{18}X_{19}HX_{20}X_{21}X_{22}X_{23}X_{24}X_{8}X_{9}CX_{10}X_{11}CX_{12}X_{13}X_{14}X_{15}X_{16}$TSGNLV RH$X_{17}X_{18}X_{19}HX_{20}X_{21}X_{22}X_{23}X_{24}X_{8}X_{9}CX_{10}X_{11}CX_{12}X_{13}X_{14}X_{15}X_{16}$QSSN LVRH$X_{17}X_{18}X_{19}HX_{20}X_{21}X_{22}X_{23}X_{24}X_{8}X_{9}CX_{10}X_{11}CX_{12}X_{13}X_{14}X_{15}X_{16}$RS DHLTTH$X_{17}X_{18}X_{19}HX_{20}X_{21}X_{22}X_{23}X_{24}X_{25}X_{26}X_{27}X_{28}X_{29}X_{30}$ | 2421 |
| gctgggagt cttggccta gcc | GCT ggg AGT CTT GGC CTA GCC | | 1324 | LEPGEKPYKCPECGKSFSDCRDL ARHQRTHTGEKPYKCPECGKSFS QNSTLTEHQRTHTGEKPYKCPEC GKSFSDPGHLVRHQRTHTGEKPY KCPECGKSFSTTGALTEHQRTHT GEKPYKCPECGKSFSHRTLTNH QRTHTGEKPYKCPECGKSFSRSD KLVRHQRTHTGEKPYKCPECGKS FSTSGELVRHQRTHTGEKPTGKK TS | 1873 | $X_1X_2X_3X_4X_5X_6X_7X_8X_9CX_{10}X_{11}CX_{12}X_{13}X_{14}X_{15}X_{16}$DCRDLARH$X_{17}X_{18}X_{19}HX_{20}X_{21}X_{22}X_{23}X_{24}X_{8}X_{9}CX_{10}X_{11}CX_{12}X_{13}X_{14}X_{15}X_{16}$QNSTLTEH$X_{17}X_{18}X_{19}HX_{20}X_{21}X_{22}X_{23}X_{24}X_{8}X_{9}CX_{10}X_{11}CX_{12}X_{13}X_{14}X_{15}X_{16}$DPGHLVRH$X_{17}X_{18}X_{19}HX_{20}X_{21}X_{22}X_{23}X_{24}X_{8}X_{9}CX_{10}X_{11}CX_{12}X_{13}X_{14}X_{15}X_{16}$TTGALTEH$X_{17}X_{18}X_{19}HX_{20}X_{21}X_{22}X_{23}X_{24}X_{8}X_{9}CX_{10}X_{11}CX_{12}X_{13}X_{14}X_{15}X_{16}$HRTTLT NH$X_{17}X_{18}X_{19}HX_{20}X_{21}X_{22}X_{23}X_{24}X_{8}X_{9}CX_{10}X_{11}CX_{12}X_{13}X_{14}X_{15}X_{16}$RSDK LVRH$X_{17}X_{18}X_{19}HX_{20}X_{21}X_{22}X_{23}X_{24}X_{8}X_{9}CX_{10}X_{11}CX_{12}X_{13}X_{14}X_{15}X_{16}$TS GELVRH$X_{17}X_{18}X_{19}HX_{20}X_{21}X_{22}X_{23}X_{24}X_{25}X_{26}X_{27}X_{28}X_{29}X_{30}$ | 2422 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gcctagcct ctgtgaagg ggt | 1325 | GCC TAG CCT TGA AGG GGT | LEPGEKPYKCPECGKSFSTSGHL VRHQRTHTGEKPYKCPECGKSFS RSDHLTNHQRTHTGEKPYKCPEC GKSFSQAGHLASHQRTHTGEKPY KCPECGKSFSRNDALTEHQRTHT GEKPYKCPECGKSFSTKNSLTEH QRTHTGEKPYKCPECGKSFSRED NLHTHQRTHTGEKPYKCPECGKS FSDCRDLARHQRTHTGEKPTGKK TS | 1874 | $X_1X_2X_3X_4X_5X_6X_7X_8X_9CX_{10}X_{11}CX_{12}X_{13}X_{14}X_{15}X_{16}TSGHLVRHX_{17}X_{18}X_{19}$ $HX_{20}X_{21}X_{22}X_{23}X_{24}X_{8}X_{9}CX_{10}X_{11}CX_{12}X_{13}X_{14}X_{15}X_{16}RSDHLTNHX_{17}X_{18}$ $X_{19}HX_{20}X_{21}X_{22}X_{23}X_{24}X_{8}X_{9}CX_{10}X_{11}CX_{12}X_{13}X_{14}X_{15}X_{16}QAGHLASHX_{17}$ $X_{18}X_{19}HX_{20}X_{21}X_{22}X_{23}X_{24}X_{8}X_{9}CX_{10}X_{11}CX_{12}X_{13}X_{14}X_{15}X_{16}RNDALTEH$ $X_{17}X_{18}X_{19}HX_{20}X_{21}X_{22}X_{23}X_{24}X_{8}X_{9}CX_{10}X_{11}CX_{12}X_{13}X_{14}X_{15}X_{16}TKNSLT$ $EHX_{17}X_{18}X_{19}HX_{20}X_{21}X_{22}X_{23}X_{24}X_{8}X_{9}CX_{10}X_{11}CX_{12}X_{13}X_{14}X_{15}X_{16}REDN$ $LHTHX_{17}X_{18}X_{19}HX_{20}X_{21}X_{22}X_{23}X_{24}X_{8}X_{9}CX_{10}X_{11}CX_{12}X_{13}X_{14}X_{15}X_{16}DC$ $RDLARHX_{17}X_{18}X_{19}HX_{20}X_{21}X_{22}X_{23}X_{24}X_{25}X_{26}X_{27}X_{28}X_{29}X_{30}$ | 2423 |
| tagcctctg tgaaggggt gga | 1326 | TAG CCT CTG TGA AGG GGT GGA | LEPGEKPYKCPECGKSFSQRAHL ERHQRTHTGEKPYKCPECGKSFS TSGHLVRHQRTHTGEKPYKCPEC GKSFSRSDHLTNHQRTHTGEKPY KCPECGKSFSQAGHLASHQRTHT GEKPYKCPECGKSFSRNDALTEH QRTHTGEKPYKCPECGKSFSTKN SLTEHQRTHTGEKPYKCPECGKS FSREDNLHTHQRTHTGEKPTGKK TS | 1875 | $X_1X_2X_3X_4X_5X_6X_7X_8X_9CX_{10}X_{11}CX_{12}X_{13}X_{14}X_{15}X_{16}QRAHLERHX_{17}X_{18}X_{19}$ $HX_{20}X_{21}X_{22}X_{23}X_{24}X_{8}X_{9}CX_{10}X_{11}CX_{12}X_{13}X_{14}X_{15}X_{16}TSGHLVRHX_{17}X_{18}$ $X_{19}HX_{20}X_{21}X_{22}X_{23}X_{24}X_{8}X_{9}CX_{10}X_{11}CX_{12}X_{13}X_{14}X_{15}X_{16}RSDHLTNHX_{17}$ $X_{18}X_{19}HX_{20}X_{21}X_{22}X_{23}X_{24}X_{8}X_{9}CX_{10}X_{11}CX_{12}X_{13}X_{14}X_{15}X_{16}QAGHLASH$ $X_{17}X_{18}X_{19}HX_{20}X_{21}X_{22}X_{23}X_{24}X_{8}X_{9}CX_{10}X_{11}CX_{12}X_{13}X_{14}X_{15}X_{16}RNDALT$ $EHX_{17}X_{18}X_{19}HX_{20}X_{21}X_{22}X_{23}X_{24}X_{8}X_{9}CX_{10}X_{11}CX_{12}X_{13}X_{14}X_{15}X_{16}TKNS$ $LTEHX_{17}X_{18}X_{19}HX_{20}X_{21}X_{22}X_{23}X_{24}X_{8}X_{9}CX_{10}X_{11}CX_{12}X_{13}X_{14}X_{15}X_{16}RE$ $DNLHTHX_{17}X_{18}X_{19}HX_{20}X_{21}X_{22}X_{23}X_{24}X_{25}X_{26}X_{27}X_{28}X_{29}X_{30}$ | 2424 |
| cctctgtga aggggtgga ggc | 1327 | CCT CTG TGA AGG GGT GGA GGC | LEPGEKPYKCPECGKSFSDPGHL VRHQRTHTGEKPYKCPECGKSFS QRAHLERHQRTHTGEKPYKCPEC GKSFSTSGHLVRHQRTHTGEKPY KCPECGKSFSRSDHLTNHQRTHT GEKPYKCPECGKSFSQAGHLASH QRTHTGEKPYKCPECGKSFSRND ALTEHQRTHTGEKPYKCPECGKS FSTKNSLTEHQRTHTGEKPTGKK TS | 1876 | $X_1X_2X_3X_4X_5X_6X_7X_8X_9CX_{10}X_{11}CX_{12}X_{13}X_{14}X_{15}X_{16}DPGHLVRHX_{17}X_{18}X_{19}$ $HX_{20}X_{21}X_{22}X_{23}X_{24}X_{8}X_{9}CX_{10}X_{11}CX_{12}X_{13}X_{14}X_{15}X_{16}QRAHLERHX_{17}X_{18}$ $X_{19}HX_{20}X_{21}X_{22}X_{23}X_{24}X_{8}X_{9}CX_{10}X_{11}CX_{12}X_{13}X_{14}X_{15}X_{16}TSGHLVRHX_{17}$ $X_{18}X_{19}HX_{20}X_{21}X_{22}X_{23}X_{24}X_{8}X_{9}CX_{10}X_{11}CX_{12}X_{13}X_{14}X_{15}X_{16}RSDHLTNH$ $X_{17}X_{18}X_{19}HX_{20}X_{21}X_{22}X_{23}X_{24}X_{8}X_{9}CX_{10}X_{11}CX_{12}X_{13}X_{14}X_{15}X_{16}QAGHLA$ $SHX_{17}X_{18}X_{19}HX_{20}X_{21}X_{22}X_{23}X_{24}X_{8}X_{9}CXHX_{11}CX_{12}X_{13}X_{14}X_{15}X_{16}RNDA$ $LTEHX_{17}X_{18}X_{19}HX_{20}X_{21}X_{22}X_{23}X_{24}X_{8}X_{9}CX_{10}X_{11}CX_{12}X_{13}X_{14}X_{15}X_{16}TK$ $NSLTEHX_{17}X_{18}X_{19}HX_{20}X_{21}X_{22}X_{23}X_{24}X_{25}X_{26}X_{27}X_{28}X_{29}X_{30}$ | 2425 |
| ggggtggag gctgtgccg ggg | 1328 | GGG GTG GAG GCT GTG CCG GGG | LEPGEKPYKCPECGKSFSRSDKL VRHQRTHTGEKPYKCPECGKSFS RNDTLTEHQRTHTGEKPYKCPEC GKSFSRNDALTEHQRTHTGEKPY KCPECGKSFSTSGELVRHQRTHT GEKPYKCPECGKSFSRSDNLVRH QRTHTGEKPYKCPECGKSFSRSD ELVRHQRTHTGEKPYKCPECGKS FSRSDKLVRHQRTHTGEKPTGKK TS | 1877 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}$ $HX_{20}X_{21}X_{22}X_{23}X_{24}X_{8}X_{9}CX_{10}X_{11}CX_{12}X_{13}X_{14}X_{15}X_{16}RNDTLTEHX_{17}X_{18}$ $X_{19}HX_{20}X_{21}X_{22}X_{23}X_{24}X_{8}X_{9}CX_{10}X_{11}CX_{12}X_{13}X_{14}X_{15}X_{16}RNDALTEHX_{17}$ $X_{18}X_{19}HX_{20}X_{21}X_{22}X_{23}X_{24}X_{8}X_{9}CX_{10}X_{11}CX_{12}X_{13}X_{14}X_{15}X_{16}TSGELVRH$ $X_{17}X_{18}X_{19}HX_{20}X_{21}X_{22}X_{23}X_{24}X_{8}X_{9}CX_{10}X_{11}CX_{12}X_{13}X_{14}X_{15}X_{16}RSDNLV$ $RHX_{17}X_{18}X_{19}HX_{20}X_{21}X_{22}X_{23}X_{24}X_{8}X_{9}CX_{10}X_{11}CX_{12}X_{13}X_{14}X_{15}X_{16}RSDE$ $LVRHX_{17}X_{18}X_{19}HX_{20}X_{21}X_{22}X_{23}X_{24}X_{8}X_{9}CX_{10}X_{11}CX_{12}X_{13}X_{14}X_{15}X_{16}RS$ $DKLVRHX_{17}X_{18}X_{19}HX_{20}X_{21}X_{22}X_{23}X_{24}X_{25}X_{26}X_{27}X_{28}X_{29}X_{30}$ | 2426 |

TABLE 10-continued

| Column 1 Nucleotide Sequence of Target Site in HNF4α Expression Control Region | Column 2 Target sequence with space | Column 3 | Column 4 Amino acid Sequence of Zinc Finger DNA Binding Domain Polypeptides Targeting the Target Site in Column 1 | Column 5 SEQ ID NO. (corresponds to sequences in Columns 1 and 3) | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gaaggggtg gaggctctg ccg | GAA GGG GTG GAG GCT CTG CCG | 158 | LEPGEKPYKCPECGKSFSRNDTL TEHQRTHTGEKPYKCPECGKSFS RNDALTEHQRTHTGEKPYKCPEC GKSFSTSGELVRHQRTHTGEKPY KCPECGKSFSRSDNLVRHQRTHT GEKPYKCPECGKSFSRSDELVRH QRTHTGEKPYKCPECGKSFSRSD KLVRHQRTHTGEKPYKCPECGKS FSQSSNLVRHQRTHTGEKPTGKK TS | 159 | $X_1X_2X_3X_4X_5X_6X_7X_8X_9CX_{10}X_{11}CX_{12}X_{13}X_{14}X_{15}X_{16}RNDTLTEHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}TSGELVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSSNLVRHX_{17}X_{18}X_{19}HX_{20}X_{21}X_{22}X_{23}X_{24}X_{25}X_{26}X_{27}X_{28}X_{29}X_{30}$ | 327 |
| gtggaggct ctgccgggg agg | GTG GAG GCT CTG CCG ggg AGG | 1329 | LEPGEKPYKCPECGKSFSRSDHL TNHQRTHTGEKPYKCPECGKSFS RSDKLVRHQRTHTGEKPYKCPEC GKSFSRNDTLTEHQRTHTGEKPY KCPECGKSFSRNDALTEHQRTHT GEKPYKCPECGKSFSTSGELVRH QRTHTGEKPYKCPECGKSFSRSD NLVRHQRTHTGEKPYKCPECGKS FSRSDELVRHQRTHTGEKPTGKK TS | 1878 | $X_1X_2X_3X_4X_5X_6X_7X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RNDTLTEHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEH_{17}X_{18}X_{19}HX_{20}X_{21}X_{22}X_{23}X_{24}X_8X_9CX_{10}X_{11}CX_{12}X_{13}X_{14}X_{15}X_{16}TSGELVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_{25}X_{26}X_{27}X_{28}X_{29}X_{30}$ | 2427 |
| gaggctctg ccggggagg ggt | GAG GCT CTG CCG ggg AGG GGT | 1330 | LEPGEKPYKCPECGKSFSTSGHL VRHQRTHTGEKPYKCPECGKSFS RSDHLTNHQRTHTGEKPYKCPEC GKSFSRSDKLVRHQRTHTGEKPY KCPECGKSFSRNDTLTEHQRTHT GEKPYKCPECGKSFSRNDALTEH QRTHTGEKPYKCPECGKSFSTSG ELVRHQRTHTGEKPYKCPECGKS FSRSDNLVRHQRTHTGEKPTGKK TS | 1879 | $X_1X_2X_3X_4X_5X_6X_7X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RNDTLTEHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}TSGELVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_{25}X_{26}X_{27}X_{28}X_{29}X_{30}$ | 2428 |
| gctctgccg ccggggggt ggg | GCT CTG CCG AGG GGT GGG | 1331 | LEPGEKPYKCPECGKSFSRSDKL VRHQRTHTGEKPYKCPECGKSFS TSGHLVRHQRTHTGEKPYKCPEC GKSFSRSDHLTNHQRTHTGEKPY KCPECGKSFSRSDKLVRHQRTHT GEKPYKCPECGKSFSRNDTLTEH QRTHTGEKPYKCPECGKSFSRND ALTEHQRTHTGEKPYKCPECGKS FSTSGELVRHQRTHTGEKPTGKK TS | 1880 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RNDTLTEHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_{25}X_{26}X_{27}X_{28}X_{29}X_{30}TSGELVRHX_{17}$ | 2429 |

TABLE 10-continued

| Column 1 Nucleotide Sequence of Target Site in HNF4α Expression Control Region | Column 2 Target sequence with space | Column 3 SEQ ID NO. (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| ctgccgggg agggtggg ggt | CTG CCG GGG AGG GGT GGG GGT | 1332 | LEPGEKPYKCPECGKSFSTSGHL VRHQRTHTGEKPYKCPECGKSFS RSDKLVRHQRTHTGEKPYKCPEC GKSFSTSGHLVRHQRTHTGEKPY KCPECGKSFSRSDHLTNHQRTHT GEKPYKCPECGKSFSRSDKLVRH QRTHTGEKPYKCPECGKSFSRND TLTEHQRTHTGEKPYKCPECGKS FSRNDALTEHQRTHTGEKPTGKK TS | 1881 | $X_1X_2X_3X_4X_5X_6X_7X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}CX_{12}X_{13}X_{14}X_{15}X_{16}RSDHLTNH X_{17}X_{18}X_{19}HX_{20}X_{21}X_{22}X_{23}X_{24}X_8X_9CX_{10}X_{11}CX_{12}X_{13}X_{14}X_{15}X_{16}RSDKLV RHX_{17}X_{18}X_{19}HX_{20}X_{21}X_{22}X_{23}X_{24}X_8X_9CX_{10}X_{11}CX_{12}X_{13}X_{14}X_{15}X_{16}RNDT LTEHX_{17}X_{18}X_{19}HX_{20}X_{21}X_{22}X_{23}X_{24}X_8X_9CX_{10}X_{11}CX_{12}XEX_{14}X_{15}X_{16}RN DALTEHX_{17}X_{18}X_{19}HX_{20}X_{21}X_{22}X_{23}X_{24}X_{25}X_{26}X_{27}X_{28}X_{29}X_{30}$ | 2430 |
| cggggaggg gtggggtt aat | CGG GGA GGG GTT AAT | 1333 | LEPGEKPYKCPECGKSFSTTGNL TVHQRTHTGEKPYKCPECGKSFS TSGSLVRHQRTHTGEKPYKCPEC GKSFSRSDKLVRHQRTHTGEKPY KCPECGKSFSRSDELVRHQRTHT GEKPYKCPECGKSFSRSDKLVRH QRTHTGEKPYKCPECGKSFSQRA HLERHQRTHTGEKPYKCPECGKS FSRSDKLTEHQRTHTGEKPTGKK TS | 1882 | $X_1X_2X_3X_4X_5X_6X_7X_8X_9CX_{10}X_{11}CX_{12}X_{13}X_{14}X_{15}X_{16}TTGNLTVHX_{17}X_{18}X_{19}HX_{20}X_{21}X_{22}X_{23}X_{24}X_8X_9CX_{10}X_{11}CX_{12}X_{13}X_{14}X_{15}X_{16}TSGSLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRH X_{17}X_{18}X_{19}HX_{20}X_{21}X_{22}X_{23}X_{24}X_8X_9CX_{10}X_{11}CX_{12}X_{13}X_{14}X_{15}X_{16}RSDKLV RHX_{17}X_{18}X_{19}HX_{20}X_{21}X_{22}X_{23}X_{24}X_8X_9CX_{10}X_{11}CX_{12}X_{13}X_{14}X_{15}X_{16}QRAH LERHX_{17}X_{18}X_{19}HX_{20}X_{21}X_{22}X_{23}X_{24}X_8X_9CX_{10}X_{11}CX_{12}X_{13}X_{14}X_{15}X_{16}RS DKLTEHX_{17}X_{18}X_{19}HX_{20}X_{21}X_{22}X_{23}X_{24}X_{25}X_{26}X_{27}X_{28}X_{29}X_{30}$ | 2431 |
| ggagggtg gggttaat ggt | GGA GGG GTG GGG GTT AAT GGT | 154 | LEPGEKPYKCPECGKSFSTSGHL VRHQRTHTGEKPYKCPECGKSFS TTGNLTVHQRTHTGEKPYKCPEC GKSFSTSGSLVRHQRTHTGEKPY KCPECGKSFSRSDKLVRHQRTHT GEKPYKCPECGKSFSRSDELVRH QRTHTGEKPYKCPECGKSFSRSD KLVRHQRTHTGEKPYKCPECGKS FSQRAHLERHQRTHTGEKPTGKK TS | 155 | $X_1X_2X_3X_4X_5X_6X_7X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}TTGNLTVHX_{17}X_{18}X_{19}HX_{20}X_{21}X_{22}X_{23}X_{24}X_8X_9CX_{10}X_{11}CX_{12}X_{13}X_{14}X_{15}X_{16}TSGSLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRH X_{17}X_{18}X_{19}HX_{20}X_{21}X_{22}X_{23}X_{24}X_8X_9CX_{10}X_{11}CX_{12}X_{13}X_{14}X_{15}X_{16}RSDELV RHX_{17}X_{18}X_{19}HX_{20}X_{21}X_{22}X_{23}X_{24}X_8X_9CX_{10}X_{11}CX_{12}X_{13}X_{14}X_{15}X_{16}RSDK LVRHX_{17}X_{18}X_{19}HX_{20}X_{21}X_{22}X_{23}X_{24}X_8X_9CX_{10}X_{11}CX_{12}X_{13}X_{14}X_{15}X_{16}QR AHLERHX_{17}X_{18}X_{19}HX_{20}X_{21}X_{22}X_{23}X_{24}X_{25}X_{26}X_{27}X_{28}X_{29}X_{30}$ | 326 |
| ggcgggct gcaggatt tgg | GGC GGG GCT GCA GGG ATT TGG | 1334 | LEPGEKPYKCPECGKSFSRSDHL TTHQRTHTGEKPYKCPECGKSFS HKNALQNHQRTHTGEKPYKCPEC GKSFSRSDKLVRHQRTHTGEKPY KCPECGKSFSQSGDLRRHQRTHT GEKPYKCPECGKSFSTSGELVRH QRTHTGEKPYKCPECGKSFSRSD KLVRHQRTHTGEKPYKCPECGKS FSDPGHLVRHQRTHTGEKPTGKK TS | 1883 | $X_1X_2X_3X_4X_5X_6X_7X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}HKNALQNHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRH X_{17}X_{18}X_{19}HX_{20}X_{21}X_{22}X_{23}X_{24}X_8X_9CXHHX_{11}CX_{12}X_{13}X_{14}X_{15}X_{16}TSGELV RHX_{17}X_{18}X_{19}HX_{20}X_{21}X_{22}X_{23}X_{24}X_8X_9CX_{10}X_{11}CX_{12}X_{13}X_{14}X_{15}X_{16}RSDK LVRHX_{17}X_{18}X_{19}HX_{20}X_{21}X_{22}X_{23}X_{24}X_8X_9CX_{10}X_{11}CX_{12}X_{13}X_{14}X_{15}X_{16}DP GHLVRHX_{17}X_{18}X_{19}HX_{20}X_{21}X_{22}X_{23}X_{24}X_{25}X_{26}X_{27}X_{28}X_{29}X_{30}$ | 2432 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| ctgggcggg gctgcaggg att | 1335 | CTG GGC GGG GCT GCA GGG ATT | LEPGEKPYKCPECGKSFSHKNAL QNHQRTHTGEKPYKCPECGKSFS RSDKLVRHQRTHTGEKPYKCPEC GKSFSQSGDLRRHQRTHTGEKPY KCPECGKSFSTSGELVRHQRTHT GEKPYKCPECGKSFSRSDKLVRH QRTHTGEKPYKCPECGKSFSDPG HLVRHQRTHTGEKPYKCPECGKS FSRNDALTEHQRTHTGEKPTGKK TS | 1884 | $X_1X_2X_3X_4X_5X_6X_7X_8X_9CX_{10}X_{11}CX_{12}X_{13}X_{14}X_{15}X_{16}$HKNALQNH$X_{17}X_{18}X_{19}$H$X_{20}X_{21}X_{22}X_{23}X_{24}X_8X_9CX_{10}X_{11}CX_{12}X_{13}X_{14}X_{15}X_{16}$RSDKLVRH$X_{17}X_{18}$ $X_{19}$H$X_{20}X_{21}X_{22}X_{23}X_{24}X_8X_9CX_{10}X_{11}CX_{12}X_{13}X_{14}X_{15}X_{16}$QSGDLRRH$X_{17}$ $X_{18}X_{19}$H$X_{20}X_{21}X_{22}X_{23}X_{24}X_8X_9CX_{10}X_{11}CX_{12}X_{13}X_{14}X_{15}X_{16}$TSGELVRH $X_{17}X_{18}X_{19}$H$X_{20}X_{21}X_{22}X_{23}X_{24}X_8X_9CX_{10}X_{11}CX_{12}X_{13}X_{14}X_{15}X_{16}$RSDKLV RH$X_{17}X_{18}X_{19}$H$X_{20}X_{21}X_{22}X_{23}X_{24}X_8X_9CX_{10}X_{11}CX_{12}X_{13}X_{14}X_{15}X_{16}$DPGH LVRH$X_{17}X_{18}X_{19}$H$X_{20}X_{21}X_{22}X_{23}X_{24}X_8X_9CX_{10}X_{11}CX_{12}X_{13}X_{14}X_{15}X_{16}$RN DALTEH$X_{17}X_{13}X_{19}$H$X_{20}X_{21}X_{22}X_{23}X_{24}X_{25}X_{26}X_{27}X_{28}X_{29}X_{30}$ | 2433 |
| gggctgcga gggatttgg ctg | 1336 | GGG GCT GCA GGG ATT TGG CTG | LEPGEKPYKCPECGKSFSRNDAL TEHQRTHTGEKPYKCPECGKSFS RSDHLTTHQRTHTGEKPYKCPEC GKSFSHKNALQNHQRTHTGEKPY KCPECGKSFSRSDKLVRHQRTHT GEKPYKCPECGKSFSQSGDLRRH QRTHTGEKPYKCPECGKSFSTSG ELVRHQRTHTGEKPYKCPECGKS FSRSDKLVRHQRTHTGEKPTGKK TS | 1885 | $X_1X_2X_3X_4X_5X_6X_7X_8X_9CX_{10}X_{11}CX_{12}X_{13}X_{14}X_{15}X_{16}$RNDALTEH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$RSDHLTTH$X_{17}X_{18}$ $X_{19}$H$X_{20}X_{21}X_{22}X_{23}X_{24}X_8X_9CX_{10}X_{11}CX_{12}X_{13}X_{14}X_{15}X_{16}$HKNALQNH$X_{17}$ $X_{18}X_{19}$H$X_{20}X_{21}X_{22}X_{23}X_{24}X_8X_9CX_{10}X_{11}CX_{12}X_{13}X_{14}X_{15}X_{16}$RSDKLVRH $X_{17}X_{18}X_{19}$H$X_{20}X_{21}X_{22}X_{23}X_{24}X_8X_9CX_{10}X_{11}CX_{12}X_{13}X_{14}X_{15}X_{16}$QSGDDR RH$X_{17}X_{18}X_{19}$H$X_{20}X_{21}X_{22}X_{23}X_{24}X_8X_9CX_{10}X_{11}CX_{12}X_{13}X_{14}X_{15}X_{16}$TSGE LVRH$X_{17}X_{18}X_{19}$H$X_{20}X_{21}X_{22}X_{23}X_{24}X_8X_9CX_{10}X_{11}CX_{12}X_{13}X_{14}X_{15}X_{16}$RS DKLVRH$X_{17}X_{13}X_{19}$H$X_{20}X_{21}X_{22}X_{23}X_{24}X_{25}X_{26}X_{27}X_{28}X_{29}X_{30}$ | 2434 |
| aggctgggc gggctgcga ggg | 150 | AGG CTG GGC GGG CTG GCA GGG | LEPGEKPYKCPECGKSFSRSDKL VRHQRTHTGEKPYKCPECGKSFS QSGDLRRHQRTHTGEKPYKCPEC GKSFSTSGELVRHQRTHTGEKPY KCPECGKSFSRSDKLVRHQRTHT GEKPYKCPECGKSFSDPGHLVRH QRTHTGEKPYKCPECGKSFSRND ALTEHQRTHTGEKPYKCPECGKS FSRSDHLTNHQRTHTGEKPTGKK TS | 151 | $X_1X_2X_3X_4X_5X_6X_7X_8X_9CX_{10}X_{11}CX_{12}X_{13}X_{14}X_{15}X_{16}$RSDKLVRH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$QSGDLRRH$X_{17}X_{18}$ $X_{19}$H$X_{20}X_{21}X_{22}X_{23}X_{24}X_8X_9CX_{10}X_{11}CX_{12}X_{13}X_1X_{14}H X_{15}X_{16}$TSGELVRH$X_{17}$ $X_{18}X_{19}$H$X_{20}X_{21}X_{22}X_{23}X_{24}X_8X_9CX_{10}X_{11}CX_{12}X_{13}X_{14}X_{15}X_{16}$RSDKLVRH $X_{17}X_{18}X_{19}$H$X_{20}X_{21}X_{22}X_{23}X_{24}X_8X_9CX_{10}X_{11}CX_{12}X_{13}X_{14}X_{15}X_{16}$DPGHLV RH$X_{17}X_{18}X_{19}$H$X_{20}X_{21}X_{22}X_{23}X_{24}X_8X_9CX_{10}X_{11}CX_{12}X_{13}X_{14}X_{15}X_{16}$RNDA LTEH$X_{17}X_{18}X_{19}$H$X_{20}X_{21}X_{22}X_{23}X_{24}X_8X_9CX_{10}X_{11}CX_{12}X_{13}X_{14}X_{15}X_{16}$RS DHLTNH$X_{17}X_{18}X_{19}$H$X_{20}X_{21}X_{22}X_{23}X_{24}X_{25}X_{26}X_{27}X_{28}X_{29}X_{30}$ | 325 |
| gtggatagg ctgggcggg gct | 1337 | GTG GAT AGG CTG GGC GGG GCT | LEPGEKPYKCPECGKSFSTSGEL VRHQRTHTGEKPYKCPECGKSFS RSDKLVRHQRTHTGEKPYKCPEC GKSFSDPGHLVRHQRTHTGEKPY KCPECGKSFSRNDALTEHQRTHT GEKPYKCPECGKSFSRSDHLTNH QRTHTGEKPYKCPECGKSFSTSG NLVRHQRTHTGEKPYKCPECGKS FSRSDELVRHQRTHTGEKPTGKK TS | 1886 | $X_1X_2X_3X_4X_5X_6X_7X_8X_9CX_{10}X_{11}CX_{12}X_{13}X_{14}X_{15}X_{16}$TSGELVRH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$RSDKLVRH$X_{17}X_{18}$ $X_{19}$H$X_{20}X_{21}X_{22}X_{23}X_{24}X_8X_9CX_{10}X_{11}CX_{12}X_{13}X_{14}X_{15}X_{16}$DPGHLVRH$X_{17}$ $X_{18}X_{19}$H$X_{20}X_{21}X_{22}X_{23}X_{24}X_8X_9CX_{10}X_{11}CX_{12}X_{13}X_{14}X_{15}X_{16}$RNDALTEH $X_{17}X_{18}X_{19}$H$X_{20}X_{21}X_{22}X_{23}X_{24}X_8X_9CX_{10}X_{11}CX_{12}X_{13}X_{14}X_{15}X_{16}$RSDHLT NH$X_{17}X_{18}X_{19}$H$X_{20}X_{21}X_{22}X_{23}X_{24}X_8X_9CX_{10}X_{11}CX_{12}X_{13}X_{14}X_{15}X_{16}$TSGN LVRH$X_{17}X_{18}X_{19}$H$X_{20}X_{21}X_{22}X_{23}X_{24}X_8X_9CX_{10}X_{11}CX_{12}X_{13}X_{14}X_{15}X_{16}$RS DELVRH$X_{17}X_{18}X_{19}$H$X_{20}X_{21}X_{22}X_{23}X_{24}X_{25}X_{26}X_{27}X_{28}X_{29}X_{30}$ | 2435 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gataggctg gcggggct gca | 1338 | GAT AGG CTG GGC GCT GCA | LEPGEKPYKCPECGKSFSQSGDL RRHQRTHTGEKPYKCPECGKSFS TSGELVRHQRTHTGEKPYKCPEC GKSFSRSDKLVRHQRTHTGEKPY KCPECGKSFSDPGHLVRHQRTHT GEKPYKCPECGKSFSRNDALTEH QRTHTGEKPYKCPECGKSFSRSD HLTNHQRTHTGEKPYKCPECGKS FSTSGNLVRHQRTHTGEKPTGKK TS | 1887 | $X_1X_2X_3X_4X_5X_6X_7X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}TSGELVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLVRHX_{17}X_{18}X_{19}HX_{20}X_{21}X_{22}X_{23}X_{24}X_{25}X_{26}X_{27}X_{28}X_{29}X_{30}$ | 2436 |
| ccgtggat aggctgggc ggg | 1339 | CCG GTG GAT AGG CTG GGC GGG | LEPGEKPYKCPECGKSFSRSDKL VRHQRTHTGEKPYKCPECGKSFS DPGHLVRHQRTHTGEKPYKCPEC GKSFSRNDALTEHQRTHTGEKPY KCPECGKSFSRSDHLTNHQRTHT GEKPYKCPECGKSFSTSGNLVRH QRTHTGEKPYKCPECGKSFSRSD ELVRHQRTHTGEKPYKCPECGKS FSRNDTLTEHQRTHTGEKPTGKK TS | 1888 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}RNDTLTEHX_{17}X_{18}X_{19}HX_{20}X_{21}X_{22}X_{23}X_{24}X_{25}X_{26}X_{27}X_{28}X_{29}X_{30}$ | 2437 |
| ccgccggtg gataggctg ggc | 1340 | CCG CCG GTG GAT AGG CTG GGC | LEPGEKPYKCPECGKSFSDPGHL VRHQRTHTGEKPYKCPECGKSFS RNDALTEHQRTHTGEKPYKCPEC GKSFSRSDHLTNHQRTHTGEKPY KCPECGKSFSTSGNLVRHQRTHT GEKPYKCPECGKSFSRSDELVRH QRTHTGEKPYKCPECGKSFSRND TLTEHQRTHTGEKPYKCPECGKS FSRNDTLTEHQRTHTGEKPTGKK TS | 1889 | $X_1X_2X_3X_4X_5X_6X_7X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}RNDTLTEHX_{17}X_{18}X_{19}HX_{20}X_{21}X_{22}X_{23}X_{24}X_{25}X_{26}X_{27}X_{28}X_{29}X_{30}$ | 2438 |
| ccccccgcc gtgatagg ctg | 1341 | CCC CCG CCG GTG GAT AGG CTG | LEPGEKPYKCPECGKSFSRNDAL TEHQRTHTGEKPYKCPECGKSFS RSDHLTNHQRTHTGEKPYKCPEC GKSFSTSGNLVRHQRTHTGEKPY KCPECGKSFSRSDELVRHQRTHT GEKPYKCPECGKSFSRNDTLTEH QRTHTGEKPYKCPECGKSFSRND TLTEHQRTHTGEKPYKCPECGKS FSSKKHLAEHQRTHTGEKPTGKK TS | 1890 | $X_1X_2X_3X_4X_5X_6X_7X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}RNDTLTEHX_{17}X_{18}X_{19}HX_{20}X_{21}X_{22}X_{23}X_{24}X_8X_9CX_{10}X_{11}CX_{12}X_{13}X_{14}X_{15}X_{16}RNDTLTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_{25}X_{26}X_{27}X_{28}X_{29}X_{30}$ | 2439 |

TABLE 10-continued

| Column 1 Nucleotide Sequence of Target Site in HNF4α Expression Control Region | Column 2 Target sequence with space | Column 3 Target sequence | Column 4 Amino acid Sequence of Zinc Finger DNA Binding Domain Polypeptides Targeting the Target Site in Column 1 | Column 5 SEQ ID NO. (corresponds to sequences in Columns 1 and 3) | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| ggtccccg ccggtggat agg | GGT CCC CCG GTG GAT AGG | | LEPGEKPYKCPECGKSFSRSDHL TNHQRTHTGEKPYKCPECGKSFS TSGNLVRHQRTHTGEKPYKCPEC GKSFSRSDELVRHQRTHTGEKPY KCPECGKSFSRNDTLTEHQRTHT GEKPYKCPECGKSFSRNDTLTEH QRTHTGEKPYKCPECGKSFSSKK HLAEHQRTHTGEKPYKCPECGKS FSTSGHLVRHQRTHTGEKPTGKK TS | 1342 | $X_1X_2X_3X_4X_5X_6X_7X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}RNDTLTEH X_{17}X_{18}X_{19}HX_{20}X_{21}X_{22}X_{23}X_{24}X_8X_9CX_{10}X_{11}CX_{12}X_{13}X_{14}X_{15}X_{16}RNDTLT EHX_{17}X_{18}X_{19}HX_{20}X_{21}X_{22}X_{23}X_{24}X_8X_9CX_{10}X_{11}CX_{12}X_{13}X_{14}X_{15}X_{16}SKKH LAEHX_{17}X_{18}X_{19}HX_{20}X_{21}X_{22}X_{23}X_{24}X_8X_9CX_{10}X_{11}CX_{12}X_{13}X_{14}X_{15}X_{16}TS GHLVRHX_{17}X_{18}X_{19}HX_{20}X_{21}X_{22}X_{23}X_{24}X_{25}X_{26}X_{27}X_{28}X_{29}X_{30}$ | 2440 |
| ataggctgg gcggggctg cag | ATA GGC TGG GCG ggg CTG CAG | | LEPGEKPYKCPECGKSFSRADNL TEHQRTHTGEKPYKCPECGKSFS RNDALTEHQRTHTGEKPYKCPEC GKSFSRSDKLVRHQRTHTGEKPY KCPECGKSFSRSDDLVRHQRTHT GEKPYKCPECGKSFSRSDHLTTH QRTHTGEKPYKCPECGKSFSDPG HLVRHQRTHTGEKPYKCPECGKS FSQKSSLIAHQRTHTGEKPTGKK TS | 1343 | $X_1X_2X_3X_4X_5X_6X_7X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDDLVRH THX_{17}X_{18}X_{19}HX_{20}X_{21}X_{22}X_{23}X_{24}X_8X_9CX_{10}X_{11}CX_{12}X_{13}X_{14}X_{15}X_{16}RSDHLT THX_{17}X_{18}X_{19}HX_{20}X_{21}X_{22}X_{23}X_{24}X_8X_9CX_{10}X_{11}CX_{12}X_{13}X_{14}X_{15}X_{16}DPGH LVRHX_{17}X_{18}X_{19}HX_{20}X_{21}X_{22}X_{23}X_{24}X_8X_9CX_{10}X_{11}CX_{12}XEX_{14}X_{15}X_{16}QK SSLIAHX_{17}X_{18}X_{19}HX_{20}X_{21}X_{22}X_{23}X_{24}X_{25}X_{26}X_{27}X_{28}X_{29}X_{30}$ | 2441 |
| cggtggata ggctgggcg ggg | CGG TGG ATA GGC TGG GCG GGG | | LEPGEKPYKCPECGKSFSRSDKL VRHQRTHTGEKPYKCPECGKSFS RSDDLVRHQRTHTGEKPYKCPEC GKSFSRSDHLTTHQRTHTGEKPY KCPECGKSFSDPGHLVRHQRTHT GEKPYKCPECGKSFSQKSSLIAH QRTHTGEKPYKCPECGKSFSRSD HLTTHQRTHTGEKPYKCPECGKS FSRSDKLTEHQRTHTGEKPTGKK TS | 1344 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDDLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRH X_{17}X_{18}X_{19}HX_{20}X_{21}X_{22}X_{23}X_{24}X_8X_9CX_{10}X_{11}CX_{12}X_{13}X_{14}X_{15}X_{16}QKSSLI AHX_{17}X_{18}X_{19}HX_{20}X_{21}X_{22}X_{23}X_{24}X_8X_9CX_{10}X_{11}CX_{12}X_{13}X_{14}X_{15}X_{16}RSDH LTTHX_{17}X_{18}X_{19}HX_{20}X_{21}X_{22}X_{23}X_{24}X_8X_9CX_{10}X_{11}CX_{12}X_{13}X_{14}X_{15}X_{16}RS DKLTEHX_{17}X_{18}X_{19}HX_{20}X_{21}X_{22}X_{23}X_{24}X_{25}X_{26}X_{27}X_{28}X_{29}X_{30}$ | 2442 |
| tggataggc ggctggggg ctg | TGG ATA GGC TGG GCG ggg CTG | | LEPGEKPYKCPECGKSFSRNDAL TEHQRTHTGEKPYKCPECGKSFS RSDKLVRHQRTHTGEKPYKCPEC GKSFSRSDDLVRHQRTHTGEKPY KCPECGKSFSDHLTTHQRTHT GEKPYKCPECGKSFSDPGHLVRH QRTHTGEKPYKCPECGKSFSQKS SLIAHQRTHTGEKPYKCPECGKS FSRSDHLTTHQRTHTGEKPTGKK TS | 1345 | $X_1X_2X_3X_4X_5X_6X_7X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDDLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTH X_{17}X_{18}X_{19}HX_{20}X_{21}X_{22}X_{23}X_{24}X_8X_9CX_{10}X_{11}CX_{12}X_{13}X_{14}X_{15}X_{16}DPGHLV RHX_{17}X_{18}X_{19}HX_{20}X_{21}X_{22}X_{23}X_{24}X_8X_9CX_{10}X_{11}CX_{12}X_{13}X_{14}X_{15}X_{16}QKSS LIAHX_{17}X_{18}X_{19}HX_{20}X_{21}X_{22}X_{23}X_{24}X_8X_9CX_{10}X_{11}CX_{12}X_{13}X_{14}X_{15}X_{16}RS DHLTTHX_{17}X_{18}X_{19}HX_{20}X_{21}X_{22}X_{23}X_{24}X_{25}X_{26}X_{27}X_{28}X_{29}X_{30}$ | 2443 |

TABLE 10-continued

| Column 1 Nucleotide Sequence of Target Site in HNF4α Expression Control Region | Column 2 Target sequence with space | Column 3 SEQ ID NO. (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| cgccggtgg ataggctgg gcg | CGC CGG TGG ATA GGC TGG GCG | 1346 | LEPGEKPYKCPECGKSFSRSDDL VRHQRTHTGEKPYKCPECGKSFS RSDHLTTHQRTHTGEKPYKCPEC GKSFSDPGHLVRHQRTHTGEKPY KCPECGKSFSQKSSLIAHQRTHT GEKPYKCPECGKSFSRSDHLTTH QRTHTGEKPYKCPECGKSFSRSD KLTEHQRTHTGEKPYKCPECGKS FSHTGHLLEHQRTHTGEKPTGKK TS | 1895 | $X_1X_2X_3X_4X_5X_6X_7X_8X_9CX_{10}X_{11}CX_{12}X_{13}X_{14}X_{15}X_{16}RSDDLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}QKSSLIAHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLTEHX_{17}X_{18}X_{19}HX_{20}X_{21}X_{22}X_{23}X_{24}X_{25}X_{26}X_{27}X_{28}X_{29}X_{30}$ | 2444 |
| gtcccccgc cggtggata ggc | GTC CCC CGC CGG TGG ATA GGC | 1347 | LEPGEKPYKCPECGKSFSDPGHL VRHQRTHTGEKPYKCPECGKSFS QKSSLIAHQRTHTGEKPYKCPEC GKSFSRSDHLTTHQRTHTGEKPY KCPECGKSFSRSDKLTEHQRTHT GEKPYKCPECGKSFSHTGHLLEH QRTHTGEKPYKCPECGKSFSSKK HLAEHQRTHTGEKPYKCPECGKS FSDPGALVRHQRTHTGEKPTGKK TS | 1896 | $X_1X_2X_3X_4X_5X_6X_7X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}QKSSLIAHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLTEHX_{17}X_{18}X_{19}HX_{20}X_{21}X_{22}X_{23}X_{24}X_8X_9CX_{10}X_{11}CX_{12}X_{13}X_{14}X_{15}X_{16}HTGHLLEHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}DPGALVRHX_{17}X_{18}X_{19}HX_{20}X_{21}X_{22}X_{23}X_{24}X_{25}X_{26}X_{27}X_{28}X_{29}X_{30}$ | 2445 |
| ccccgccgg tggataggc tgg | CCC CGC CGG TGG ATA GGC TGG | 1348 | LEPGEKPYKCPECGKSFSRSDHL TTHQRTHTGEKPYKCPECGKSFS DPGHLVRHQRTHTGEKPYKCPEC GKSFSQKSSLIAHQRTHTGEKPY KCPECGKSFSRSDHLTTHQRTHT GEKPYKCPECGKSFSRSDKLTEH QRTHTGEKPYKCPECGKSFSHTG HLLEHQRTHTGEKPYKCPECGKS FSSKKHLAEHQRTHTGEKPTGKK TS | 1897 | $X_1X_2X_3X_4X_5X_6X_7X_8X_9CX_{10}X_{11}CX_{12}X_{13}X_{14}X_{15}X_{16}RSDHLTTHX_{17}XHX_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}QKSSLIAHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLTEHX_{17}X_{18}X_{19}HX_{20}X_{21}X_{22}X_{23}X_{24}X_8X_9CX_{10}X_{11}CX_{12}X_{13}X_{14}X_{15}X_{16}HTGHLLEHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_{25}X_{26}X_{27}X_{28}X_{29}X_{30}$ | 2446 |
| ggctgggcg gggctgcag gga | GGC TGG ggg GCG CTG CAG GGA | 1349 | LEPGEKPYKCPECGKSFSQRAHL ERHQRTHTGEKPYKCPECGKSFS RADNLTEHQRTHTGEKPYKCPEC GKSFSRNDALTEHQRTHTGEKPY KCPECGKSFSRSDKLVRHQRTHT GEKPYKCPECGKSFSRSDDLVRH QRTHTGEKPYKCPECGKSFSRSD HLTTHQRTHTGEKPYKCPECGKS FSDPGHLVRHQRTHTGEKPTGKK TS | 1898 | $X_1X_2X_3X_4X_5X_6X_7X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDDLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_{25}X_{26}X_{27}X_{28}X_{29}X_{30}$ | 2447 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| ggtgatag gctgggcgg ggc | 1350 | GGT GGA TAG GCT ggg CGG GGC | LEPGEKPYKCPECGKSFSDPGHL VRHQRTHTGEKPYKCPECGKSFS RSDKLTEHQRTHTGEKPYKCPEC GKSFSRSDKLVRHQRTHTGEKPY KCPECGKSFSTSGELVRHQRTHT GEKPYKCPECGKSFSREDNLHTH QRTHTGEKPYKCPECGKSFSQRA HLERHQRTHTGEKPYKCPECGKS FSTSGHLVRHQRTHTGEKPTGKK TS | 1899 | $X_1X_2X_3X_4X_5X_6X_7X_8X_9CX_{10}X_{11}CX_{12}X_{13}X_{14}X_{15}X_{16}DPGHLVRHX_{17}X_{18}X_{19}$ $HX_{20}X_{21}X_{22}X_{23}X_{24}X_8X_9CX_{10}X_{11}CX_{12}X_{13}X_{14}X_{15}X_{16}RSDKLTEHX_{17}X_{18}$ $X_{19}HX_{20}X_{21}X_{22}X_{23}X_{24}X_8X_9CX_{10}X_{11}CX_{12}X_{13}X_{14}X_{15}X_{16}RSDKLVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}TSGELVRH$ $X_{17}X_{18}X_{19}HX_{20}X_{21}X_{22}X_{23}X_{24}X_8X_9CX_{10}X_{11}CX_{12}X_{13}X_{14}X_{15}X_{16}REDNLH$ $THX_{17}X_{18}X_{19}HX_{20}X_{21}X_{22}X_{23}X_{24}X_8X_9CX_{10}X_{11}CX_{12}X_{13}X_{14}X_{15}X_{16}QRAH$ $LERHX_{17}X_{18}X_{19}HX_{20}X_{21}X_{22}X_{23}X_{24}X_8X_9CX_{10}X_{11}CX_{12}X_{13}X_{14}X_{15}X_{16}TS$ $GHLVRHX_{17}X_{18}X_{19}HX_{20}X_{21}X_{22}X_{23}X_{24}X_{25}X_{26}X_{27}X_{28}X_{29}X_{30}$ | 2448 |
| gccgtgga taggctggg cgg | 1351 | GCC GGT GGA TAG GCT ggg CGG | LEPGEKPYKCPECGKSFSRSDKL TEHQRTHTGEKPYKCPECGKSFS RSDKLVRHQRTHTGEKPYKCPEC GKSFSTSGELVRHQRTHTGEKPY KCPECGKSFSREDNLHTHQRTHT GEKPYKCPECGKSFSQRAHLERH QRTHTGEKPYKCPECGKSFSTSG HLVRHQRTHTGEKPYKCPECGKS FSDCRDLARHQRTHTGEKPTGKK TS | 1900 | $X_1X_2X_3X_4X_5X_6X_7X_8X_9CX_{10}X_{11}CX_{12}X_{13}X_{14}X_{15}X_{16}RSDKLTEHX_{17}X_{18}X_{19}$ $HX_{20}X_{21}X_{22}X_{23}X_{24}X_8X_9CX_{10}X_{11}CX_{12}X_{13}X_{14}X_{15}X_{16}RSDKLVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}TSGELVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}REDNLHTH$ $X_{17}X_{18}X_{19}HX_{20}X_{21}X_{22}X_{23}X_{24}X_8X_9CX_{10}X_{11}CX_{12}X_{13}X_{14}X_{15}X_{16}QRAHLE$ $RHX_{17}X_{18}X_{19}HX_{20}X_{21}X_{22}X_{23}X_{24}X_8X_9CX_{10}X_{11}CX_{12}X_{13}X_{14}X_{15}X_{16}TSGH$ $LVRHX_{17}X_{18}X_{19}HX_{20}X_{21}X_{22}X_{23}X_{24}X_8X_9CX_{10}X_{11}CX_{12}X_{13}X_{14}X_{15}X_{16}DC$ $RDLARHX_{17}X_{18}X_{19}HX_{20}X_{21}X_{22}X_{23}X_{24}X_{25}X_{26}X_{27}X_{28}X_{29}X_{30}$ | 2449 |
| cccgccggt ggataggct ggg | 1352 | CCC GCC GGT GGA TAG GCT GGG | LEPGEKPYKCPECGKSFSRSDKL VRHQRTHTGEKPYKCPECGKSFS TSGELVRHQRTHTGEKPYKCPEC GKSFSREDNLHTHQRTHTGEKPY KCPECGKSFSQRAHLERHQRTHT GEKPYKCPECGKSFSTSGHLVRH QRTHTGEKPYKCPECGKSFSDCR DLARHQRTHTGEKPYKCPECGKS FSSKKHLAEHQRTHTGEKPTGKK TS | 1901 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}$ $HX_{20}X_{21}X_{22}X_{23}X_{24}X_8X_9CX_{10}X_{11}CX_{12}X_{13}X_{14}X_{15}X_{16}TSGELVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}REDNLHTHX_{17}$ $X_{18}X_{19}HX_{20}X_{21}X_{22}X_{23}X_{24}X_8X_9CX_{10}X_{11}CX_{12}X_{13}X_{14}X_{15}X_{16}QRAHLERH$ $X_{17}X_{18}X_{19}HX_{20}X_{21}X_{22}X_{23}X_{24}X_8X_9CX_{10}X_{11}CX_{12}X_{13}X_{14}X_{15}X_{16}TSGHLV$ $RHX_{17}X_{18}X_{19}HX_{20}X_{21}X_{22}X_{23}X_{24}X_8X_9CX_{10}X_{11}CX_{12}X_{13}X_{14}X_{15}X_{16}DCRD$ $LARHX_{17}X_{18}X_{19}HX_{20}X_{21}X_{22}X_{23}X_{24}X_8X_9CX_{10}X_{11}CX_{12}X_{13}X_{14}X_{15}X_{16}SK$ $KHLAEHX_{17}X_{18}X_{19}HX_{20}X_{21}X_{22}X_{23}X_{24}X_{25}X_{26}X_{27}X_{28}X_{29}X_{30}$ | 2450 |
| gctgacacc cggggtgct aat | 1353 | GCT GAC ACC CGG GGT GCT AAT | LEPGEKPYKCPECGKSFSTTGNL TVHQRTHTGEKPYKCPECGKSFS TSGELVRHQRTHTGEKPYKCPEC GKSFSTSGHLVRHQRTHTGEKPY KCPECGKSFSRSDKLTEHQRTHT GEKPYKCPECGKSFSDKKDLTRH QRTHTGEKPYKCPECGKSFSDPG NLVRHQRTHTGEKPYKCPECGKS FSTSGELVRHQRTHTGEKPTGKK TS | 1902 | $X_1X_2X_3X_4X_5X_6X_7X_8X_9CX_{10}X_{11}CX_{12}X_{13}X_{14}X_{15}X_{16}TTGNLTVHX_{17}X_{18}X_{19}$ $HX_{20}X_{21}X_{22}X_{23}X_{24}X_8X_9CX_{10}X_{11}CX_{12}X_{13}X_{14}X_{15}X_{16}TSGELVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}TSGHLVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}RSDKLTEH$ $X_{17}X_{18}X_{19}HX_{20}X_{21}X_{22}X_{23}X_{24}X_8X_9CX_{10}X_{11}CX_{12}X_{13}X_{14}X_{15}X_{16}DKKDLT$ $RHX_{17}X_{18}X_{19}HX_{20}X_{21}X_{22}X_{23}X_{24}X_8X_9CX_{10}X_{11}CX_{12}X_{13}X_{14}X_{15}X_{16}DPGN$ $LVRHX_{17}X_{18}X_{19}HX_{20}X_{21}X_{22}X_{23}X_{24}X_8X_9CX_{10}X_{11}CX_{12}X_{13}X_{14}X_{15}X_{16}TS$ $GELVRHX_{17}X_{18}X_{19}HX_{20}X_{21}X_{22}X_{23}X_{24}X_{25}X_{26}X_{27}X_{28}X_{29}X_{30}$ | 2451 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| ctgctgac acccggggt gct | 1354 | CTG GCT GAC ACC CGG GGT GCT | LEPGEKPYKCPECGKSFSTSGEL VRHQRTHTGEKPYKCPECGKSFS TSGHLVRHQRTHTGEKPYKCPEC GKSFSRSDKLTEHQRTHTGEKPY KCPECGKSFSDKKDLTRHQRTHT GEKPYKCPECGKSFSDPGNLVRH QRTHTGEKPYKCPECGKSFSTSG ELVRHQRTHTGEKPYKCPECGKS FSRNDALTEHQRTHTGEKPTGKK TS | 1903 | $X_1X_2X_3X_4X_5X_6X_7X_8X_9CX_{10}X_{11}CX_{12}X_{13}X_{14}X_{15}X_{16}TSGELVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLTEHX_{17}X_{18}X_{19}HX_{20}X_{21}X_{22}X_{23}X_{24}X_8X_9CX_{10}X_{11}CX_{12}X_{13}X_{14}X_{15}X_{16}DKKDLTRHX_{17}X_{18}X_{19}HX_{20}X_{21}X_{22}X_{23}X_{24}X_8X_9CX_{10}X_{11}CX_{12}X_{13}X_{14}X_{15}X_{16}DPGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGELVRHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_{25}X_{26}X_{27}X_{28}X_{29}X_{30}$ | 2452 |
| acaactgct ggggccta act | 1355 | ACA ACT GCT GGG GCC CTA ACT | LEPGEKPYKCPECGKSFSTHLDL IRHQRTHTGEKPYKCPECGKSFS QNSTLTEHQRTHTGEKPYKCPEC GKSFSDCRDLARHQRTHTGEKPY KCPECGKSFSRSDKLVRHQRTHT GEKPYKCPECGKSFSTSGELVRH QRTHTGEKPYKCPECGKSFSTHL DLIRHQRTHTGEKPYKCPECGKS FSSPADLTRHQRTHTGEKPTGKK TS | 1904 | $X_1X_2X_3X_4X_5X_6X_7X_8X_9CX_{10}X_{11}CX_{12}X_{13}X_{14}X_{15}X_{16}THLDLIRHX_{17}X_{18}X_{19}HX_{20}X_{21}X_{22}X_{23}X_{24}X_8X_9CX_{10}X_{11}CX_{12}X_{13}X_{14}X_{15}X_{16}QNSTLTEHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGELVRHX_{17}X_{18}X_{19}HX_{20}X_{21}X_{22}X_{23}X_{24}X_8X_9CX_{10}X_{11}CX_{12}X_{13}X_{14}X_{15}X_{16}THLDLIRHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_{25}X_{26}X_{27}X_{28}X_{29}X_{30}$ | 2453 |
| ctaattaca actgctggg gcc | 1356 | CTA ATT ACA ACT GCT GGG GCC | LEPGEKPYKCPECGKSFSDCRDL ARHQRTHTGEKPYKCPECGKSFS RSDKLVRHQRTHTGEKPYKCPEC GKSFSTSGELVRHQRTHTGEKPY KCPECGKSFSTHLDLIRHQRTHT GEKPYKCPECGKSFSSPADLTRH QRTHTGEKPYKCPECGKSFSHKN ALQNHQRTHTGEKPYKCPECGKS FSQNSTLTEHQRTHTGEKPTGKK TS | 1905 | $X_1X_2X_3X_4X_5X_6X_7X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGELVRHX_{17}X_{18}X_{19}HX_{20}X_{21}X_{22}X_{23}X_{24}X_8X_9CX_{10}X_{11}CX_{12}X_{13}X_{14}X_{15}X_{16}THLDLIRHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}HKNALQNHX_{17}X_{18}X_{19}HX_{20}X_{21}X_{22}X_{23}X_{24}X_8X_9CX_{10}X_{11}CX_{12}X_{13}X_{14}X_{15}X_{16}QNSTLTEHX_{17}EHX_{17}X_{18}X_{19}HX_{20}X_{21}X_{22}X_{23}X_{24}X_{25}X_{26}X_{27}X_{28}X_{29}X_{30}$ | 2454 |
| attacaaact gctggggcc cta | 1357 | ATT ACA ACT GCT GGG GCC CTA | LEPGEKPYKCPECGKSFSQNSTL TEHQRTHTGEKPYKCPECGKSFS DCRDLARHQRTHTGEKPYKCPEC GKSFSRSDKLVRHQRTHTGEKPY KCPECGKSFSTSGELVRHQRTHT GEKPYKCPECGKSFSTHLDLIRH QRTHTGEKPYKCPECGKSFSSPA DLTRHQRTHTGEKPYKCPECGKS FSHKNALQNHQRTHTGEKPTGKK TS | 1906 | $X_1X_2X_3X_4X_5X_6X_7X_8X_9CX_{10}X_{11}CX_{12}X_{13}X_{14}X_{15}X_{16}QNSTLTEHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGELVRHX_{17}X_{18}X_{19}HX_{20}X_{21}X_{22}X_{23}X_{24}X_8X_9CX_{10}X_{11}CX_{12}X_{13}X_{14}X_{15}X_{16}THLDLIRHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}HKNALQNHX_{17}X_{18}X_{19}HX_{20}X_{21}X_{22}X_{23}X_{24}X_{25}X_{26}X_{27}X_{28}X_{29}X_{30}$ | 2455 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gtgctaatt acaactgct ggg | 1358 | gtg CTA ATT ACA ACT GCT GGG | LEPGEKPYKCPECGKSFSRSDKL VRHQRTHTGEKPYKCPECGKSFS TSGELVRHQRTHTGEKPYKCPEC GKSFSTHLDLIRHQRTHTGEKPY KCPECGKSFSSPADLTRHQRTHT GEKPYKCPECGKSFSHKNALQNH QRTHTGEKPYKCPECGKSFSQNS TLTEHQRTHTGEKPYKCPECGKS FSRSDELVRHQRTHTGEKPTGKK TS | 1907 | $X_1X_2X_3X_4X_5X_6X_7X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGELVRHX_{17}X_{18}X_{19}HX_{20}X_{21}X_{22}X_{23}X_{24}X_8X_9CX_{10}X_{11}CX_{12}X_{13}X_{14}X_{15}X_{16}THLDLIRHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}HKNALQNHX_{17}X_{18}X_{19}HX_{20}X_{21}X_{22}X_{23}X_{24}X_8X_9CX_{10}X_{11}CX_{12}X_{13}X_{14}X_{15}X_{16}QNSTLTEHX_{17}X_{18}X_{19}HX_{20}X_{21}X_{22}X_{23}X_{33}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_{25}X_{26}X_{27}X_{28}X_{29}X_{30}$ | 2456 |
| gggtgcta attacaact gct | 1359 | GGG gtg CTA ATT ACA ACT GCT | LEPGEKPYKCPECGKSFSTSGEL VRHQRTHTGEKPYKCPECGKSFS THLDLIRHQRTHTGEKPYKCPEC GKSFSSPADLTRHQRTHTGEKPY KCPECGKSFSHKNALQNHQRTHT GEKPYKCPECGKSFSQNSTLTEH QRTHTGEKPYKCPECGKSFSRSD ELVRHQRTHTGEKPYKCPECGKS FSRSDKLVRHQRTHTGEKPTGKK TS | 1908 | $X_1X_2X_3X_4X_5X_6X_7X_8X_9CX_{10}X_{11}CX_{12}X_{13}X_{14}X_{15}X_{16}TSGELVRHX_{17}X_{18}X_{19}HX_{20}X_{21}X_{22}X_{23}X_{24}X_8X_9CX_{10}X_{11}CX_{12}X_{13}X_{14}X_{15}X_{16}THLDLIRHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}HKNALQNHX_{17}X_{18}X_{19}HX_{20}X_{21}X_{22}X_{23}X_{24}X_8X_9CX_{10}X_{11}CX_{12}X_{13}X_{14}X_{15}X_{16}QNS+32EHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_{25}X_{26}X_{27}X_{28}X_{29}X_{30}$ | 2457 |
| actgctggg gcctaact cac | 1360 | ACT GCT GGG GCC CTA ACT CAC | LEPGEKPYKCPECGKSFSKKAL TEHQRTHTGEKPYKCPECGKSFS THLDLIRHQRTHTGEKPYKCPEC GKSFSQNSTLTEHQRTHTGEKPY KCPECGKSFSDCRDLARHQRTHT GEKPYKCPECGKSFSRSDKLVRH QRTHTGEKPYKCPECGKSFSTSG ELVRHQRTHTGEKPYKCPECGKS FSTHLDLIRHQRTHTGEKPTGKK TS | 1909 | $X_1X_2X_3X_4X_5X_6X_7X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}THLDLIRHX_{17}X_{18}X_{19}HX_{20}X_{21}X_{22}X_{23}X_{24}X_8X_9CX_{10}X_{11}CX_{12}X_{13}X_{14}X_{15}X_{16}QNSTLTEHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGELVRHX_{17}X_{18}X_{19}HX_{20}X_{21}X_{22}X_{23}X_{24}X_8X_9CX_{10}X_{11}CX_{12}XEX_{14}X_{15}X_{16}THLDLIRHX_{17}X_{18}X_{19}HX_{20}X_{21}X_{22}X_{23}X_{24}X_{25}X_{26}X_{27}X_{28}X_{29}X_{30}$ | 2458 |
| cccgggtg ctaattaca act | 1361 | CCC GGG gtg CTA ATT ACA ACT | LEPGEKPYKCPECGKSFSTHLDL IRHQRTHTGEKPYKCPECGKSFS SPADLTRHQRTHTGEKPYKCPEC GKSFSHKNALQNHQRTHTGEKPY KCPECGKSFSQNSTLTEHQRTHT GEKPYKCPECGKSFSRSDELVRH QRTHTGEKPYKCPECGKSFSRSD KLVRHQRTHTGEKPYKCPECGKS FSSKKHLAEHQRTHTGEKPTGKK TS | 1910 | $X_1X_2X_3X_4X_5X_6X_7X_8X_9CX_{10}X_{11}CX_{12}X_{13}X_{14}X_{15}X_{16}THLDLIRHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}HKNALQNHX_{17}X_{18}X_{19}HX_{20}X_{21}X_{22}X_{23}X_{24}X_8X_9CX_{10}X_{11}CX_{12}X_{13}X_{14}X_{15}X_{16}QNSTLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_{25}X_{26}X_{27}X_{28}X_{29}X_{30}$ | 2459 |

TABLE 10-continued

| Column 1 Nucleotide Sequence of Target Site in HNF4α Expression Control Region | Column 3 Target sequence with space | Column 2 SEQ ID NO. (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| tggctgaca cccggggtg cta | TGG CTG ACA CCC GGG gtg CTA | 1362 | LEPGEKPYKCPECGKSFSQNSTL TEHQRTHTGEKPYKCPECGKSFS RSDELVRHQRTHTGEKPYKCPEC GKSFSRSDKLVRHQRTHTGEKPY KCPECGKSFSSKKHLAEHQRTHT GEKPYKCPECGKSFSSPADLTRH QRTHTGEKPYKCPECGKSFSRND ALTEHQRTHTGEKPYKCPECGKS FSRSDHLTTHQRTHTGEKPTGKK TS | 1911 | $X_1X_2X_3X_4X_5X_6X_7X_8X_9CX_{10}X_{11}CX_{12}X_{13}X_{14}X_{15}X_{16}QNSTLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_{25}X_{26}X_{27}X_{28}X_{29}X_{30}$ DHLTTHX$_{17}$X$_{18}$X$_{19}$HX$_{20}$X$_{21}$X$_{22}$X$_{23}$X$_{24}$X$_{25}$X$_{26}$X$_{27}$X$_{28}$X$_{29}$X$_{30}$ | 2460 |
| acacccggg gtgctaatt aca | ACA CCC GGG gtg CTA ATT ACA | 1363 | LEPGEKPYKCPECGKSFSSPADL TRHQRTHTGEKPYKCPECGKSFS HKNALQNHQRTHTGEKPYKCPEC GKSFSQNSTLTEHQRTHTGEKPY KCPECGKSFSRSDELVRHQRTHT GEKPYKCPECGKSFSRSDKLVRH QRTHTGEKPYKCPECGKSFSSKK HLAEHQRTHTGEKPYKCPECGKS FSSPADLTRHQRTHTGEKPTGKK TS | 1912 | $X_1X_2X_3X_4X_5X_6X_7X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}X_{13}X_{14}X_{15}X_{16}HKNALQNHX_{17}X_{18}X_{19}HX_{20}X_{21}X_{22}X_{23}X_{24}X_8X_9CX_{10}X_{11}CX_{12}X_{13}X_{14}X_{15}X_{16}QNSTLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_{25}X_{26}X_{27}X_{28}X_{29}X_{30}$ | 2461 |
| ctgacaccc gggtgcta att | CTG ACA CCC GGG gtg CTA ATT | 1364 | LEPGEKPYKCPECGKSFSHKNAL QNHQRTHTGEKPYKCPECGKSFS QNSTLTEHQRTHTGEKPYKCPEC GKSFSRSDELVRHQRTHTGEKPY KCPECGKSFSRSDKLVRHQRTHT GEKPYKCPECGKSFSSKKHLAEH QRTHTGEKPYKCPECGKSFSSPA DLTRHQRTHTGEKPYKCPECGKS FSRNDALTEHQRTHTGEKPTGKK TS | 1913 | $X_1X_2X_3X_4X_5X_6X_7X_8X_9CX_{10}X_{11}CX_{12}X_{13}X_{14}X_{15}X_{16}HKNALQNHX_{17}X_{18}X_{19}HX_{20}X_{21}X_{22}X_{23}X_{24}X_8X_9CX_{10}X_{11}CX_{12}X_{13}X_{14}X_{15}X_{16}QNSTLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDELVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}SPADLTRHX_{17}X_{18}X_{19}HX_{20}X_{21}X_{22}X_{23}X_{24}X_8X_9CX_{10}X_{11}CX_{12}XEX_{14}X_{15}X_{16}RNDALTEHX_{17}X_{18}X_{19}HX_{20}X_{21}X_{22}X_{23}X_{24}X_{25}X_{26}X_{27}X_{28}X_{29}X_{30}$ | 2462 |
| gctggggcc gcctaactcac cga | GCT GGG GCC CTA ACT CAC CGA | 1365 | LEPGEKPYKCPECGKSFSQSGHL TEHQRTHTGEKPYKCPECGKSFS SKKALTEHQRTHTGEKPYKCPEC GKSFSTHLDLIRHQRTHTGEKPY KCPECGKSFSQNSTLTEHQRTHT GEKPYKCPECGKSFSDCRDLARH QRTHTGEKPYKCPECGKSFSRSD KLVRHQRTHTGEKPYKCPECGKS FSTSGELVRHQRTHTGEKPTGKK TS | 1914 | $X_1X_2X_3X_4X_5X_6X_7X_8X_9CX_{10}X_{11}CX_{12}X_{13}X_{14}X_{15}X_{16}QSGHLTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKALTEHX_{17}X_{18}X_{19}HX_{20}X_{21}X_{22}X_{23}X_{24}X_8X_9CX_{10}X_{11}CX_{12}X_{13}X_{14}X_{15}X_{16}THLDLIRHX_{17}X_{18}X_{19}HX_{20}X_{21}X_{22}X_{23}X_{24}X_8X_9CX_{10}X_{11}CX_{12}X_{13}X_{14}X_{15}X_{16}QNSTLTEHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}RSDKLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGELVRHX_{17}X_{18}X_{19}HX_{20}X_{21}X_{22}X_{23}X_{24}X_{25}X_{26}X_{27}X_{28}X_{29}X_{30}$ | 2463 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| attgtacaa ggcaggcat cat | 1366 | ATT GTA CAA GGC AGG CAT CAT | LEPGEKPYKCPECGKSFSTSGNL TEHQRTHTGEKPYKCPECGKSFS TSGNLTEHQRTHTGEKPYKCPEC GKSFSRSDHLTNHQRTHTGEKPY KCPECGKSFSDPGHLVRHQRTHT GEKPYKCPECGKSFSQSGNLTEH QRTHTGEKPYKCPECGKSFSQSS SLVRHQRTHTGEKPYKCPECGKS FSHKNALQNHQRTHTGEKPTGKK TS | 1915 | $X_1X_2X_3X_4X_5X_6X_7X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}QSSSLVRHX_{17}X_{18}X_{19}HX_{20}X_{21}X_{22}X_{23}X_{24}X_{25}X_{26}X_{27}X_{28}X_{29}X_{30}$ | 2464 |
| gtacaaggc aggcatcat gac | 1367 | GTA CAA GGC AGG CAT CAT GAC | LEPGEKPYKCPECGKSFSDPGNL VRHQRTHTGEKPYKCPECGKSFS TSGNLTEHQRTHTGEKPYKCPEC GKSFSTSGNLTEHQRTHTGEKPY KCPECGKSFSRSDHLTNHQRTHT GEKPYKCPECGKSFSDPGHLVRH QRTHTGEKPYKCPECGKSFSQSG NLTEHQRTHTGEKPYKCPECGKS FSQSSLVRHQRTHTGEKPTGKK TS | 1916 | $X_1X_2X_3X_4X_5X_6X_7X_8X_9CX_{10}X_{11}CX_{12}X_{13}X_{14}X_{15}X_{16}DPGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTNHX_{17}X_{18}X_{19}HX_{20}X_{21}X_{22}X_{23}X_{24}X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSGNLTEHX_{17}X_{18}X_{19}HX_{20}X_{21}X_{22}X_{23}X_{24}X_8X_9CX_{10}X_{11}CX_{12}X_{13}X_{14}X_{15}X_{16}QSSSLVRHX_{17}X_{18}X_{19}HX_{20}X_{21}X_{22}X_{23}X_{24}X_{25}X_{26}X_{27}X_{28}X_{29}X_{30}$ | 2465 |
| atgtcaccc ccaagtcag gca | 1368 | ATT GTC ACC CCA AGT CAG GCA | LEPGEKPYKCPECGKSFSQSGDL RRHQRTHTGEKPYKCPECGKSFS RADNLTEHQRTHTGEKPYKCPEC GKSFSHRTTLTNHQRTHTGEKPY KCPECGKSFSTSHSLTEHQRTHT GEKPYKCPECGKSFSDKKDLTRH QRTHTGEKPYKCPECGKSFSDPG ALVRHQRTHTGEKPYKCPECGKS FSHKNALQNHQRTHTGEKPTGKK TS | 1917 | $X_1X_2X_3X_4X_5X_6X_7X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}HRTTLTNHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}DKKDLTRHX_{17}X_{18}X_{19}HX_{20}X_{21}X_{22}X_{23}X_{24}X_8X_9CX_{10}X_{11}CX_{12}X_{13}X_{14}X_{15}X_{16}DPGALVRHX_{17}X_{18}X_{19}HX_{20}X_{21}X_{22}X_{23}X_{24}X_{25}X_{26}X_{27}X_{28}X_{29}X_{30}$ | 2466 |
| gccattgtc acccaagt cag | 1369 | GCC ATT GTC ACC CCA AGT CAG | LEPGEKPYKCPECGKSFSRADNL TEHQRTHTGEKPYKCPECGKSFS HRTTLTNHQRTHTGEKPYKCPEC GKSFSTSHSLTEHQRTHTGEKPY KCPECGKSFSDKKDLTRHQRTHT GEKPYKCPECGKSFSDPGALVRH QRTHTGEKPYKCPECGKSFSHKN ALQNHQRTHTGEKPYKCPECGKS FSDCRDLARHQRTHTGEKPTGKK TS | 1918 | $X_1X_2X_3X_4X_5X_6X_7X_8X_9CX_{10}X_{11}CX_{12}X_{13}X_{14}X_{15}X_{16}RADNLTEHX_{17}X_{18}X_{19}HX_{20}X_{21}X_{22}X_{23}X_{24}X_8X_9CX_{10}X_{11}CX_{12}X_{13}X_{14}X_{15}X_{16}HRTTLTNHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}DKKDLTRHX_{17}X_{18}X_{19}HX_{20}X_{21}X_{22}X_{23}X_{24}X_8X_9CX_{10}X_{11}CX_{12}X_{13}X_{14}X_{15}X_{16}DPGALVRHX_{17}X_{18}X_{19}HX_{20}X_{21}X_{22}X_{23}X_{24}X_8X_9CX_{10}X_{11}CX_{12}X_{13}X_{14}X_{15}X_{16}HKNALQNHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_{25}X_{26}X_{27}X_{28}X_{29}X_{30}$ | 2467 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| caagcatt gtcacccca agt | 1370 | CAA GCC ATT GTC ACC CCA AGT | LEPGEKPYKCPECGKSFSHRTTL TNHQRTHTGEKPYKCPECGKSFS TSHSLTEHQRTHTGEKPYKCPEC GKSFSDKKDLTRHQRTHTGEKPY KCPECGKSFSDPGALVRHQRTHT GEKPYKCPECGKSFSHKNALQNH QRTHTGEKPYKCPECGKSFSDCR DLARHQRTHTGEKPYKCPECGKS FSQSGNLTEHQRTHTGEKPTGKK TS | 1919 | $X_1X_2X_3X_4X_5X_6X_7X_8X_9CX_{10}X_{11}CX_{12}X_{13}X_{14}X_{15}X_{16}$HRTTLTNH$X_{17}X_{18}X_{19}$H$X_{20}X_{21}X_{22}X_{23}X_{24}X_8X_9CX_{10}X_{11}CX_{12}X_{13}X_{14}X_{15}X_{16}$TSHSLTEH$X_{17}X_{18}$ $X_{19}$H$X_{20}X_{21}X_{22}X_{23}X_{24}X_8X_9CX_{10}X_{11}CX_{12}X_{13}X_{14}X_{15}X_{16}$DKKDLTRH$X_{17}$ $X_{18}X_{19}$H$X_{20}X_{21}X_{22}X_{23}X_{24}X_8X_9CX_{10}X_{11}CX_{12}X_{13}X_{14}X_{15}X_{16}$DPGALVRH $X_{17}X_{18}X_{19}$H$X_{20}X_{21}X_{22}X_{23}X_{24}X_8X_9CX_{10}X_{11}CX_{12}X_{13}X_{14}X_{15}X_{16}$HKNALQ NH$X_{17}X_{18}X_{19}$H$X_{20}X_{21}X_{22}X_{23}X_{24}X_8X_9CX_{10}X_{11}CX_{12}X_{13}X_{14}X_{15}X_{16}$DCRD LARH$X_{17}X_{18}X_{19}$H$X_{20}X_{21}X_{22}X_{23}X_{24}X_8X_9CX_{10}X_{11}CX_{12}X_{13}X_{14}X_{15}X_{16}$QS GNLTEH$X_{17}X_{18}X_{19}$H$X_{20}X_{21}X_{22}X_{23}X_{24}X_{25}X_{26}X_{27}X_{28}X_{29}X_{30}$ | 2468 |
| ggcactgac agcctacct ccg | 1371 | GGC ACT GAC AGC CTA CCT CCG | LEPGEKPYKCPECGKSFSRNDTL TEHQRTHTGEKPYKCPECGKSFS TKNSLTEHQRTHTGEKPYKCPEC GKSFSQNSLTEHQRTHTGEKPY KCPECGKSFSERSHLREHQRTHT GEKPYKCPECGKSFSDPGNLVRH QRTHTGEKPYKCPECGKSFSTHL DLIRHQRTHTGEKPYKCPECGKS FSDPGHLVRHQRTHTGEKPTGKK TS | 1920 | $X_1X_2X_3X_4X_5X_6X_7X_8X_9CX_{10}X_{11}CX_{12}X_{13}X_{14}X_{15}X_{16}$RNDTLTEH$X_{17}X_{18}X_{19}$H$X_{20}X_{21}X_{22}X_{23}X_{24}X_8X_9CX_{10}X_{11}CX_{12}X_{13}X_{14}X_{15}X_{16}$TKNSLTEH$X_{17}X_{18}$ $X_{19}$H$X_{20}X_{21}X_{22}X_{23}X_{24}X_8X_9CX_{10}X_{11}CX_{12}X_{13}X_{14}X_{15}X_{16}$QNSLTEH$X_{17}$ $X_{18}X_{19}$H$X_{20}X_{21}X_{22}X_{23}X_{24}X_8X_9CX_{10}X_{11}CX_{12}X_{13}X_{14}X_{15}X_{16}$ERSHLREH $X_{17}X_{18}X_{19}$H$X_{20}X_{21}X_{22}X_{23}X_{24}X_8X_9CX_{10}X_{11}CX_{12}X_{13}X_{14}X_{15}X_{16}$DPGNLV RH$X_{17}X_{18}X_{19}$H$X_{20}X_{21}X_{22}X_{23}X_{24}X_8X_9CX_{10}X_{11}CX_{12}X_{13}X_{14}X_{15}X_{16}$THLD LIRH$X_{17}X_{18}X_{19}$H$X_{20}X_{21}X_{22}X_{23}X_{24}X_8X_9CX_{10}X_{11}CX_{12}X_{13}X_{14}X_{15}X_{16}$DP GHLVRH$X_{17}X_{18}X_{19}$H$X_{20}X_{21}X_{22}X_{23}X_{24}X_{25}X_{26}X_{27}X_{28}X_{29}X_{30}$ | 2469 |
| actgacagc ctacctccg aga | 1372 | ACT GAC AGC CTA CCT CCG AGA | LEPGEKPYKCPECGKSFSQLAHL RAHQRTHTGEKPYKCPECGKSFS RNDTLTEHQRTHTGEKPYKCPEC GKSFSTKNSLTEHQRTHTGEKPY KCPECGKSFSQNSLTEHQRTHT GEKPYKCPECGKSFSERSHLREH QRTHTGEKPYKCPECGKSFSDPG NLVRHQRTHTGEKPYKCPECGKS FSTHLDLIRHQRTHTGEKPTGKK TS | 1921 | $X_1X_2X_3X_4X_5X_6X_7X_8X_9CX_{10}X_{11}CX_{12}X_{13}X_{14}X_{15}X_{16}$QLAHLRAH$X_{17}X_{18}X_{19}$H$X_{20}X_{21}X_{22}X_{23}X_{24}X_8X_9CX_{10}X_{11}CX_{12}X_{13}X_{14}X_{15}X_{16}$RNDTLTEH$X_{17}X_{18}$ $X_{19}$H$X_{20}X_{21}X_{22}X_{23}X_{24}X_8X_9CX_{10}X_{11}CX_{12}X_{13}X_{14}X_{15}X_{16}$TKNSLTEH$X_{17}$ $X_{18}X_{19}$H$X_{20}X_{21}X_{22}X_{23}X_{24}X_8X_9CX_{10}X_{11}CX_{12}X_{13}X_{14}X_{15}X_{16}$QNSLTEH $X_{17}X_{18}X_{19}$H$X_{20}X_{21}X_{22}X_{23}X_{24}X_8X_9CX_{10}X_{11}CX_{12}X_{13}X_{14}X_{15}X_{16}$ERSHLR EH$X_{17}X_{18}X_{19}$H$X_{20}X_{21}X_{22}X_{23}X_{24}X_8X_9CX_{10}X_{11}CX_{12}X_{13}X_{14}X_{15}X_{16}$DPGN LVRH$X_{17}X_{18}X_{19}$H$X_{20}X_{21}X_{22}X_{23}X_{24}X_8X_9CX_{10}X_{11}CX_{12}X_{13}X_{14}X_{15}X_{16}$TH LDLIRH$X_{17}X_{18}X_{19}$H$X_{20}X_{21}X_{22}X_{23}X_{24}X_{25}X_{26}X_{27}X_{28}X_{29}X_{30}$ | 2470 |
| ccaaatcat tgacttcta ccc | 1373 | CCA AAT CAT TGA CTT CTA CCC | LEPGEKPYKCPECGKSFSSKKHL AEHQRTHTGEKPYKCPECGKSFS QNSTLTEHQRTHTGEKPYKCPEC GKSFSTTGALTEHQRTHTGEKPY KCPECGKSFSQAGHLASHQRTHT GEKPYKCPECGKSFSTSGNLTEH QRTHTGEKPYKCPECGKSFSTTG NLTVHQRTHTGEKPYKCPECGKS FSTSHSLTEHQRTHTGEKPTGKK TS | 1922 | $X_1X_2X_3X_4X_5X_6X_7X_8X_9CX_{10}X_{11}CX_{12}X_{13}X_{14}X_{15}X_{16}$SKKHLAEH$X_{17}X_{18}X_{19}$H$X_{20}X_{21}X_{22}X_{23}X_{24}X_8X_9CX_{10}X_{11}CX_{12}X_{13}X_{14}X_{15}X_{16}$QNSTLTEH$X_{17}X_{18}$ $X_{19}$H$X_{20}X_{21}X_{22}X_{23}X_{24}X_8X_9CX_{10}X_{11}CX_{12}X_{13}X_{14}X_{15}X_{16}$TTGALTEH$X_{17}$ $X_{18}X_{19}$H$X_{20}X_{21}X_{22}X_{23}X_{24}X_8X_9CX_{10}X_{11}CX_{12}X_{13}X_{14}X_{15}X_{16}$QAGHLASH $X_{17}X_{18}X_{19}$H$X_{20}X_{21}X_{22}X_{23}X_{24}X_8X_9CX_{10}X_{11}CX_{12}X_{13}X_{14}X_{15}X_{16}$TSGNLT EH$X_{17}X_{18}X_{19}$H$X_{20}X_{21}X_{22}X_{23}X_{24}X_8X_9CX_{10}X_{11}CX_{12}X_{13}X_{14}X_{15}X_{16}$TTGN LTVH$X_{17}X_{18}X_{19}$H$X_{20}X_{21}X_{22}X_{23}X_{24}X_8X_9CX_{10}X_{11}CX_{12}X_{13}X_{14}X_{15}X_{16}$TS HSLTEH$X_{17}X_{18}X_{19}$H$X_{20}X_{21}X_{22}X_{23}X_{24}X_{25}X_{26}X_{27}X_{28}X_{29}X_{30}$ | 2471 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gcagagata aggctgccc cat | 1374 | GCA gag ATA AGG CTG CCC CAT | LEPGEKPYKCPECGKSFSTSGNL TEHQRTHTGEKPYKCPECGKSFS SKKHLAEHQRTHTGEKPYKCPEC GKSFSRNDALTEHQRTHTGEKPY KCPECGKSFSRSDHLTNHQRTHT GEKPYKCPECGKSFSQKSSLIAH QRTHTGEKPYKCPECGKSFSRSD NLVRHQRTHTGEKPYKCPECGKS FSQSGDLRRHQRTHTGEKPTGKK TS | 1923 | $X_1X_2X_3X_4X_5X_6X_7X_8X_9CX_{10}X_{11}CX_{12}X_{13}X_{14}X_{15}X_{16}TSGNLTEHX_{17}X_{18}X_{19}$ $HX_{20}X_{21}X_{22}X_{23}X_{24}X_8X_9CX_{10}X_{11}CX_{12}X_{13}X_{14}X_{15}X_{16}SKKHLAEHX_{17}X_{18}$ $X_{19}HX_{20}X_{21}X_{22}X_{23}X_{24}X_8X_9CX_{10}X_{11}CX_{12}X_{13}X_{14}X_{15}X_{16}RNDALTEHX_{17}$ $X_{18}X_{19}HX_{20}X_{21}X_{22}X_{23}X_{24}X_8X_9CX_{10}X_{11}CX_{12}X_{13}X_{14}X_{15}X_{16}RSDHLTNH$ $X_{17}X_{18}X_{19}HX_{20}X_{21}X_{22}X_{23}X_{24}X_8X_9CXHX_{11}CX_{12}X_{13}X_{14}X_{15}X_{16}QKSSLI$ $AHX_{17}X_{18}X_{19}HX_{20}X_{21}X_{22}X_{23}X_{24}X_8X_9CX_{10}X_{11}CX_{12}X_{13}X_{14}X_{15}X_{16}RSDN$ $LVRHX_{17}X_{18}X_{19}HX_{20}X_{21}X_{22}X_{23}X_{24}X_8X_9CX_{10}X_{11}CX_{12}X_{13}X_{14}X_{15}X_{16}QS$ $GDLRRHX_{17}X_{18}X_{19}HX_{20}X_{21}X_{22}X_{23}X_{24}X_{25}X_{26}X_{27}X_{28}X_{29}X_{30}$ | 2472 |
| gagataagg ctgcccat ggc | 1375 | gag ATA AGG CTG CCC CAT GGC | LEPGEKPYKCPECGKSFSDPGHL VRHQRTHTGEKPYKCPECGKSFS TSGNLTEHQRTHTGEKPYKCPEC GKSFSSKKHLAEHQRTHTGEKPY KCPECGKSFSRNDALTEHQRTHT GEKPYKCPECGKSFSRSDHLTNH QRTHTGEKPYKCPECGKSFSQKS SLIAHQRTHTGEKPYKCPECGKS FSRSDNLVRHQRTHTGEKPTGKK TS | 1924 | $X_1X_2X_3X_4X_5X_6X_7X_8X_9CX_{10}X_{11}CX_{12}X_{13}X_{14}X_{15}X_{16}DPGHLVRHX_{17}X_{18}X_{19}$ $HX_{20}X_{21}X_{22}X_{23}X_{24}X_8X_9CX_{10}X_{11}CX_{12}X_{13}X_{14}X_{15}X_{16}TSGNLTEHX_{17}X_{18}$ $X_{19}HX_{20}X_{21}X_{22}X_{23}X_{24}X_8X_9CX_{10}X_{11}CX_{12}X_{13}X_{14}X_{15}X_{16}SKKHLAEHX_{17}$ $X_{18}X_{19}HX_{20}X_{21}X_{22}X_{23}X_{24}X_8X_9CX_{10}X_{11}CX_{12}X_{13}X_{14}X_{15}X_{16}RNDALTEH$ $X_{17}X_{18}X_{19}HX_{20}X_{21}X_{22}X_{23}X_{24}X_8X_9CX_{10}X_{11}CX_{12}X_{13}X_{14}X_{15}X_{16}RSDHLT$ $NHX_{17}X_{18}X_{19}HX_{20}X_{21}X_{22}X_{23}X_{24}X_8X_9CX_{10}X_{11}CX_{12}X_{13}X_{14}X_{15}X_{16}QKSS$ $LIAHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DNLVRHX_{17}X_{18}X_{19}HX_{20}X_{21}X_{22}X_{23}X_{24}X_{25}X_{26}X_{27}X_{28}X_{29}X_{30}$ | 2473 |
| ataaggctg cccatggc cca | 1376 | ATA AGG CTG CCC CAT GGC CCA | LEPGEKPYKCPECGKSFSTSHSL TEHQRTHTGEKPYKCPECGKSFS DPGHLVRHQRTHTGEKPYKCPEC GKSFSTSGNLTEHQRTHTGEKPY KCPECGKSFSSKKHLAEHQRTHT GEKPYKCPECGKSFSRNDALTEH QRTHTGEKPYKCPECGKSFSRSD HLTNHQRTHTGEKPYKCPECGKS FSQKSSLIAHQRTHTGEKPTGKK TS | 1925 | $X_1X_2X_3X_4X_5X_6X_7X_8X_9CX_{10}X_{11}CX_{12}X_{13}X_{14}X_{15}X_{16}TSHSLTEHX_{17}X_{18}X_{19}$ $HX_{20}X_{21}X_{22}X_{23}X_{24}X_8X_9CX_{10}X_{11}CX_{12}X_{13}X_{14}X_{15}X_{16}DPGHLVRHX_{17}X_{18}$ $X_{19}HX_{20}X_{21}X_{22}X_{23}X_{24}X_8X_9CX_{10}X_{11}CX_{12}X_{13}X_{14}X_{15}X_{16}TSGNLTEHX_{17}$ $X_{18}X_{19}HX_{20}X_{21}X_{22}X_{23}X_{24}X_8X_9CX_{10}X_{11}CX_{12}X_{13}X_{14}X_{15}X_{16}SKKHLAEH$ $X_{17}X_{18}X_{19}HX_{20}X_{21}X_{22}X_{23}X_{24}X_8X_9CX_{10}X_{11}CX_{12}X_{13}X_{14}X_{15}X_{16}RNDALT$ $EHX_{17}X_{18}X_{19}HX_{20}X_{21}X_{22}X_{23}X_{24}X_8X_9CX_{10}X_{11}CX_{12}X_{13}X_{14}X_{15}X_{16}RSDH$ $LTNHX_{17}X_{18}X_{19}HX_{20}X_{21}X_{22}X_{23}X_{24}X_8X_9CX_{10}X_{11}CX_{12}X_{13}X_{14}X_{15}X_{16}QK$ $SSLIAHX_{17}X_{18}X_{19}HX_{20}X_{21}X_{22}X_{23}X_{24}X_{25}X_{26}X_{27}X_{28}X_{29}X_{30}$ | 2474 |
| aggctgccc catggccca cga | 1377 | AGG CTG CCC CAT GGC CCA CGA | LEPGEKPYKCPECGKSFSQSGHL TEHQRTHTGEKPYKCPECGKSFS TSHSLTEHQRTHTGEKPYKCPEC GKSFSDPGHLVRHQRTHTGEKPY KCPECGKSFSTSGNLTEHQRTHT GEKPYKCPECGKSFSSKKHLAEH QRTHTGEKPYKCPECGKSFSRND ALTEHQRTHTGEKPYKCPECGKS FSRSDHLTNHQRTHTGEKPTGKK TS | 1926 | $X_1X_2X_3X_4X_5X_6X_7X_8X_9CX_{10}X_{11}CX_{12}X_{13}X_{14}X_{15}X_{16}QSGHLTEHX_{17}X_{18}X_{19}$ $HX_{20}X_{21}X_{22}X_{23}X_{24}X_8X_9CX_{10}X_{11}CX_{12}X_{13}X_{14}X_{15}X_{16}TSHSLTEHX_{17}X_{18}$ $X_{19}HX_{20}X_{21}X_{22}X_{23}X_{24}X_8X_9CX_{10}X_{11}CX_{12}X_{13}X_{14}X_{15}X_{16}DPGHLVRHX_{17}$ $X_{18}X_{19}HX_{20}X_{21}X_{22}X_{23}X_{24}X_8X_9CX_{10}X_{11}CX_{12}X_{13}X_{14}X_{15}X_{16}TSGNLTEH$ $X_{17}X_{18}X_{19}HX_{20}X_{21}X_{22}X_{23}X_{24}X_8X_9CX_{10}X_{11}CX_{12}X_{13}X_{14}X_{15}X_{16}SKKHLA$ $EHX_{17}X_{18}X_{19}HX_{20}X_{21}X_{22}X_{23}X_{24}X_8X_9CX_{10}X_{11}CX_{12}X_{13}X_{14}X_{15}X_{16}RNDA$ $LTEHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DHLTNHX_{17}X_{18}X_{19}HX_{20}X_{21}X_{22}X_{23}X_{24}X_{25}X_{26}X_{27}X_{28}X_{29}X_{30}$ | 2475 |

TABLE 10-continued

| Column 1 Nucleotide Sequence of Target Site in HNF4α Expression Control Region | Column 2 Target sequence with space | Column 3 Target sequence | Column 4 Amino acid Sequence of Zinc Finger DNA Binding Domain Polypeptides Targeting the Target Site in Column 1 | Column 5 SEQ ID NO. (corresponds to sequences in Columns 1 and 3) | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| agagataag gctgccca tgg | AGA GAT AAG GCT GCC CCA TGG | | LEPGEKPYKCPECGKSFSRSDHL TTHQRTHTGEKPYKCPECGKSFS TSHSLTEHQRTHTGEKPYKCPEC GKSFSDCRDLARHQRTHTGEKPY KCPECGKSFSTSGELVRHQRTHT GEKPYKCPECGKSFRKDNLKNH QRTHTGEKPYKCPECGKSFSTSG NLVRHQRTHTGEKPYKCPECGKS FSQLAHLRAHQRTHTGEKPTGKK TS | 1378 | $X_1X_2X_3X_4X_5X_6X_7X_8X_9CX_{10}X_{11}CX_{12}X_{13}X_{14}X_{15}X_{16}RSDHLTTHX_{17}X_{18}X_{19}$ $HX_{20}X_{21}X_{22}X_{23}X_{24}X_8X_9CX_{10}X_{11}CX_{12}X_{13}X_{14}X_{15}X_{16}TSHSLTEHX_{17}X_{18}$ $X_{19}HX_{20}X_{21}X_{22}X_{23}X_{24}X_8X_9CX_{10}X_{11}CX_{12}X_{13}X_{14}X_{15}X_{16}DCRDLARHX_{17}$ $X_{18}X_{19}HX_{20}X_{21}X_{22}X_{23}X_{24}X_8X_9CX_{10}X_{11}CX_{12}X_{13}X_{14}X_{15}X_{16}TSGELVRH$ $X_{17}X_{18}X_{19}HX_{20}X_{21}X_{22}X_{23}X_{24}X_8X_9CX_{10}X_{11}CX_{12}X_{13}X_{14}X_{15}X_{16}RKDNLK$ $NHX_{17}X_{18}X_{19}HX_{20}X_{21}X_{22}X_{23}X_{24}X_8X_9CX_{10}X_{11}CX_{12}X_{13}X_{14}X_{15}X_{16}TSGN$ $LVRHX_{17}X_{18}X_{19}HX_{20}X_{21}X_{22}X_{23}X_{24}X_8X_9CX_{10}X_{11}CX_{12}X_{13}X_{14}X_{15}X_{16}QL$ $AHLRAHX_{17}X_{18}X_{19}HX_{20}X_{21}X_{22}X_{23}X_{24}X_{25}X_{26}X_{27}X_{28}X_{29}X_{30}$ | 2476 |
| cccacgatt tagaaacct aaa | CCC ACG ATT TAG AAA CCT AAA | | LEPGEKPYKCPECGKSFSQRANL RAHQRTHTGEKPYKCPECGKSFS TKNSLTEHQRTHTGEKPYKCPEC GKSFSQRANLRAHQRTHTGEKPY KCPECGKSFSREDNLHTHQRTHT GEKPYKCPECGKSFSHKNALQNH QRTHTGEKPYKCPECGKSFSRTD TLRDHQRTHTGEKPYKCPECGKS FSSKKHLAEHQRTHTGEKPTGKK TS | 1379 | $X_1X_2X_3X_4X_5X_6X_7X_8X_9CX_{10}X_{11}CX_{12}X_{13}X_{14}X_{15}X_{16}QRANLRAHX_{17}X_{18}X_{19}$ $HX_{20}X_{21}X_{22}X_{23}X_{24}X_8X_9CX_{10}X_{11}CX_{12}X_{13}X_{14}X_{15}X_{16}TKNSLTEHX_{17}X_{18}$ $X_{19}HX_{20}X_{21}X_{22}X_{23}X_{24}X_8X_9CX_{10}X_{11}CX_{12}X_{13}X_{14}X_{15}X_{16}QRANLRAHX_{17}$ $X_{18}X_{19}HX_{20}X_{21}X_{22}X_{23}X_{24}X_8X_9CX_{10}X_{11}CX_{12}X_{13}X_{14}X_{15}X_{16}REDNLHTH$ $X_{17}X_{18}X_{19}HX_{20}X_{21}X_{22}X_{23}X_{24}X_8X_9CX_{10}X_{11}CX_{12}X_{13}X_{14}X_{15}X_{16}HKNALQ$ $NHX_{17}X_{18}X_{19}HX_{20}X_{21}X_{22}X_{23}X_{24}X_8X_9CX_{10}X_{11}CX_{12}X_{13}X_{14}X_{15}X_{16}RTDT$ $LRDHX_{17}X_{18}X_{19}HX_{20}X_{21}X_{22}X_{23}X_{24}X_8X_9CX_{10}X_{11}CX_{12}X_{13}X_{14}X_{15}X_{16}SK$ $KHLAEHX_{17}X_{18}X_{19}HX_{20}X_{21}X_{22}X_{23}X_{24}X_{25}X_{26}X_{27}X_{28}X_{29}X_{30}$ | 2477 |
| tggcccacg attagaaa cct | TGG CCC ACG ATT TAG AAA CCT | | LEPGEKPYKCPECGKSFSTKNSL TEHQRTHTGEKPYKCPECGKSFS QRANLRAHQRTHTGEKPYKCPEC GKSFSREDNLHTHQRTHTGEKPY KCPECGKSFSHKNALQNHQRTHT GEKPYKCPECGKSFSRTDTLRDH QRTHTGEKPYKCPECGKSFSSKK HLAEHQRTHTGEKPYKCPECGKS FSRSDHLTTHQRTHTGEKPTGKK TS | 1380 | $X_1X_2X_3X_4X_5X_6X_7X_8X_9CX_{10}X_{11}CX_{12}X_{13}X_{14}X_{15}X_{16}TKNSLTEHX_{17}X_{18}X_{19}$ $HX_{20}X_{21}X_{22}X_{23}X_{24}X_8X_9CX_{10}X_{11}CX_{12}X_{13}X_{14}X_{15}X_{16}QRANLRAHX_{17}X_{18}$ $X_{19}HX_{20}X_{21}X_{22}X_{23}X_{24}X_8X_9CX_{10}X_{11}CX_{12}X_{13}X_{14}X_{15}X_{16}REDNLHTHX_{17}$ $X_{18}X_{19}HX_{20}X_{21}X_{22}X_{23}X_{24}X_8X_9CX_{10}X_{11}CX_{12}X_{13}X_{14}X_{15}X_{16}HKNALQNH$ $X_{17}X_{18}X_{19}HX_{20}X_{21}X_{22}X_{23}X_{24}X_8X_9CX_{10}X_{11}CX_{12}X_{13}X_{14}X_{15}X_{16}RTDTLR$ $DHX_{17}X_{18}X_{19}HX_{20}X_{21}X_{22}X_{23}X_{24}X_8X_9CX_{10}X_{11}CX_{12}X_{13}X_{14}X_{15}X_{16}SKKH$ $LAEHX_{17}X_{18}X_{19}HX_{20}X_{21}X_{22}X_{23}X_{24}X_8X_9CX_{10}X_{11}CX_{12}X_{13}X_{14}X_{15}X_{16}RS$ $DHLTTHX_{17}X_{18}X_{19}HX_{20}X_{21}X_{22}X_{23}X_{24}X_{25}X_{26}X_{27}X_{28}X_{29}X_{30}$ | 2478 |
| ccatggccc acgattag aaa | CCA TGG CCC ACG ATT TAG AAA | | LEPGEKPYKCPECGKSFSQRANL RAHQRTHTGEKPYKCPECGKSFS REDNLHTHQRTHTGEKPYKCPEC GKSFSHKNALQNHQRTHTGEKPY KCPECGKSFSRTDTLRDHQRTHT GEKPYKCPECGKSFSSKKHLAEH QRTHTGEKPYKCPECGKSFSRSD HLTTHQRTHTGEKPYKCPECGKS FSTSHSLTEHQRTHTGEKPTGKK TS | 1381 | $X_1X_2X_3X_4X_5X_6X_7X_8X_9CX_{10}X_{11}CX_{12}X_{13}X_{14}X_{15}X_{16}QRANLRAHX_{17}X_{18}X_{19}$ $HX_{20}X_{21}X_{22}X_{23}X_{24}X_8X_9CX_{10}X_{11}CX_{12}X_{13}X_{14}X_{15}X_{16}REDNLHTHX_{17}X_{18}$ $X_{19}HX_{20}X_{21}X_{22}X_{23}X_{24}X_8X_9CX_{10}X_{11}CX_{12}X_{13}X_{14}X_{15}X_{16}HKNALQNHX_{17}$ $X_{18}X_{19}HX_{20}X_{21}X_{22}X_{23}X_{24}X_8X_9CX_{10}X_{11}CX_{12}X_{13}X_{14}X_{15}X_{16}RTDTLRDH$ $X_{17}X_{18}X_{19}HX_{20}X_{21}X_{22}X_{23}X_{24}X_8X_9CX_{10}X_{11}CX_{12}X_{13}X_{14}X_{15}X_{16}SKKHLA$ $EHX_{17}X_{18}X_{19}HX_{20}X_{21}X_{22}X_{23}X_{24}X_8X_9CX_{10}X_{11}CX_{12}X_{13}X_{14}X_{15}X_{16}RSDH$ $LTTHX_{17}X_{18}X_{19}HX_{20}X_{21}X_{22}X_{23}X_{24}X_8X_9CX_{10}X_{11}CX_{12}X_{13}X_{14}X_{15}X_{16}TS$ $HSLTEHX_{17}X_{18}X_{19}HX_{20}X_{21}X_{22}X_{23}X_{24}X_{25}X_{26}X_{27}X_{28}X_{29}X_{30}$ | 2479 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gcccatgg cccacgatt tag | 1382 | GCC CCA TGG CCC ACG ATT TAG | LEPGEKPYKCPECGKSFSREDNL HTHQRTHTGEKPYKCPECGKSFS HKNALQNHQRTHTGEKPYKCPEC GKSFSRTDTLRDHQRTHTGEKPY KCPECGKSFSSKKHLAEHQRTHT GEKPYKCPECGKSFSRSDHLTTH QRTHTGEKPYKCPECGKSFSTSH SLTEHQRTHTGEKPYKCPECGKS FSDCRDLARHQRTHTGEKPTGKK TS | 1931 | $X_1X_2X_3X_4X_5X_6X_7X_8X_9CX_{10}X_{11}CX_{12}X_{13}X_{14}X_{15}X_{16}REDNLHTHX_{17}X_{18}X_{19}HX_{20}X_{21}X_{22}X_{23}X_{24}X_8X_9CX_{10}X_{11}CX_{12}X_{13}X_{14}X_{15}X_{16}HKNALQNHX_{17}X_{18}X_{19}HX_{20}X_{21}X_{22}X_{23}X_{24}X_8X_9CX_{10}X_{11}CX_{12}X_{13}X_{14}X_{15}X_{16}RTDTLRDHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_{25}X_{26}X_{27}X_{28}X_{29}X_{30}$ | 2480 |
| gataaggct gcccatgg ccc | 1383 | GAT AAG GCT GCC CCA TGG CCC | LEPGEKPYKCPECGKSFSSKKHL AEHQRTHTGEKPYKCPECGKSFS RSDHLTTHQRTHTGEKPYKCPEC GKSFSTSHSLTEHQRTHTGEKPY KCPECGKSFSDCRDLARHQRTHT GEKPYKCPECGKSFSTSGELVRH QRTHTGEKPYKCPECGKSFSRKD NLKNHQRTHTGEKPYKCPECGKS FSTSGNLVRHQRTHTGEKPTGKK TS | 1932 | $X_1X_2X_3X_4X_5X_6X_7X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}TSGELVRHX_{17}X_{18}X_{19}HX_{20}X_{21}X_{22}X_{23}X_{24}X_8X_9CX_{10}X_{11}CX_{12}X_{13}X_{14}X_{15}X_{16}RKDNLKNHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLVRHX_{17}X_{18}X_{19}HX_{20}X_{21}X_{22}X_{23}X_{24}X_{25}X_{26}X_{27}X_{28}X_{29}X_{30}$ | 2481 |
| gctgcccca tggcccacg att | 1384 | GCT GCC CCA TGG CCC ACG ATT | LEPGEKPYKCPECGKSFSHKNAL QNHQRTHTGEKPYKCPECGKSFS RTDTLRDHQRTHTGEKPYKCPEC GKSFSSKKHLAEHQRTHTGEKPY KCPECGKSFSRSDHLTTHQRTHT GEKPYKCPECGKSFSTSHSLTEH QRTHTGEKPYKCPECGKSFSDCR DLARHQRTHTGEKPYKCPECGKS FSTSGELVRHQRTHTGEKPTGKK TS | 1933 | $X_1X_2X_3X_4X_5X_6X_7X_8X_9CX_{10}X_{11}CX_{12}X_{13}X_{14}X_{15}X_{16}HKNALQNHX_{17}X_{18}X_{19}HX_{20}X_{21}X_{22}X_{23}X_{24}X_8X_9CX_{10}X_{11}CX_{12}X_{13}X_{14}X_{15}X_{16}RTDTLRDHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}TSGELVRHX_{17}X_{18}X_{19}HX_{20}X_{21}X_{22}X_{23}X_{24}X_{25}X_{26}X_{27}X_{28}X_{29}X_{30}$ | 2482 |
| aaggctgcc ccatggccc acg | 1385 | AAG GCT GCC CCA TGG CCC ACG | LEPGEKPYKCPECGKSFSRTDTL RDHQRTHTGEKPYKCPECGKSFS SKKHLAEHQRTHTGEKPYKCPEC GKSFSRSDHLTTHQRTHTGEKPY KCPECGKSFSTSHSLTEHQRTHT GEKPYKCPECGKSFSDCRDLARH QRTHTGEKPYKCPECGKSFSTSG ELVRHQRTHTGEKPYKCPECGKS FSRKDNLKNHQRTHTGEKPTGKK TS | 1934 | $X_1X_2X_3X_4X_5X_6X_7X_8X_9CX_{10}X_{11}CX_{12}X_{13}X_{14}X_{15}X_{16}RTDTLRDHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}TSHSLTEHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}TSGELVRHX_{17}X_{18}X_{19}HX_{20}X_{21}X_{22}X_{23}X_{24}X_8X_9CX_{10}X_{11}CX_{12}X_{13}X_{14}X_{15}X_{16}RK$ $DNLKNHX_{17}X_{18}X_{19}HX_{20}X_{21}X_{22}X_{23}X_{24}X_{25}X_{26}X_{27}X_{28}X_{29}X_{30}$ | 2483 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| agaaaccta aatcccagg ccc | 1386 | AGA AAC CTA AAT CCC AGG CCC | LEPGEKPYKCPECGKSFSSKKHL AEHQRTHTGEKPYKCPECGKSFS RSDHLTNHQRTHTGEKPYKCPEC GKSFSSKKHLAEHQRTHTGEKPY KCPECGKSFSTTGNLTVHQRTHT GEKPYKCPECGKSFSQNSTLTEH QRTHTGEKPYKCPECGKSFSDSG NLRVHQRTHTGEKPYKCPECGKS FSQLAHLRAHQRTHTGEKPTGKK TS | 1935 | $X_1X_2X_3X_4X_5X_6X_7X_8X_9CX_{10}X_{11}CX_{12}X_{13}X_{14}X_{15}X_{16}$SKKHLAEH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$RSDHLTNH$X_{17}X_{18}$ $X_{19}$H$X_{20}X_{21}X_{22}X_{23}X_{24}X_8X_9CX_{10}X_{11}CX_{12}X_{13}X_{14}X_{15}X_{16}$SKKHLAEH$X_{17}$ $X_{18}X_{19}$H$X_{20}X_{21}X_{22}X_{23}X_{24}X_8X_9CX_{10}X_{11}CX_{12}X_{13}X_{14}X_{15}X_{16}$TTGNLTVH $X_{17}X_{18}X_{19}$H$X_{20}X_{21}X_{22}X_{23}X_{24}X_8X_9CX_{10}X_{11}CX_{12}X_{13}X_{14}X_{15}X_{16}$QNSTLT EH$X_{17}X_{18}X_{19}$H$X_{20}X_{21}X_{22}X_{23}X_{24}X_8X_9CX_{10}X_{11}CX_{12}X_{13}X_{14}X_{15}X_{16}$DSGN LRVH$X_{17}X_{18}X_{19}$H$X_{20}X_{21}X_{22}X_{23}X_{24}X_8X_9CX_{10}X_{11}CX_{12}X_{13}X_{14}X_{15}X_{16}$QL AHLRAH$X_{17}X_{18}X_{19}$H$X_{20}X_{21}X_{22}X_{23}X_{24}X_{25}X_{26}X_{27}X_{28}X_{29}X_{30}$ | 2484 |
| aacctaaat cccaggccc cag | 1387 | AAC CTA AAT CCC AGG CCC CAG | LEPGEKPYKCPECGKSFSRADNL TEHQRTHTGEKPYKCPECGKSFS SKKHLAEHQRTHTGEKPYKCPEC GKSFSRSDHLTNHQRTHTGEKPY KCPECGKSFSSKKHLAEHQRTHT GEKPYKCPECGKSFSTTGNLTVH QRTHTGEKPYKCPECGKSFSQNS TLTEHQRTHTGEKPYKCPECGKS FSDSGNLRVHQRTHTGEKPTGKK TS | 1936 | $X_1X_2X_3X_4X_5X_6X_7X_8X_9CX_{10}X_{11}CX_{12}X_{13}X_{14}X_{15}X_{16}$RADNLTEH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$SKKHLAEH$X_{17}X_{18}$ $X_{19}$H$X_{20}X_{21}X_{22}X_{23}X_{24}X_8X_9CX_{10}X_{11}CX_{12}X_{13}X_{14}X_{15}X_{16}$RSDHLTNH$X_{17}$ $X_{18}X_{19}$H$X_{20}X_{21}X_{22}X_{23}X_{24}X_8X_9CX_{10}X_{11}CX_{12}X_{13}X_{14}X_{15}X_{16}$SKKHLAEH $X_{17}X_{18}X_{19}$H$X_{20}X_{21}X_{22}X_{23}X_{24}X_8X_9CX_{10}X_{11}CX_{12}X_{13}X_{14}X_{15}X_{16}$TTGNLT VH$X_{17}X_{18}X_{19}$H$X_{20}X_{21}X_{22}X_{23}X_{24}X_8X_9CX_{10}X_{11}CX_{12}X_{13}X_{14}X_{15}X_{16}$QNST LTEH$X_{17}X_{18}X_{19}$H$X_{20}X_{21}X_{22}X_{23}X_{24}X_8X_9CX_{10}X_{11}CX_{12}X_{13}X_{14}X_{15}X_{16}$DS GNLRVH$X_{17}X_{18}X_{19}$H$X_{20}X_{21}X_{22}X_{23}X_{24}X_{25}X_{26}X_{27}X_{28}X_{29}X_{30}$ | 2485 |
| ctaaatccc aggcccccag atg | 1388 | CTA AAT CCC AGG CCC CAG ATG | LEPGEKPYKCPECGKSFSRRDEL NVHQRTHTGEKPYKCPECGKSFS RADNLTEHQRTHTGEKPYKCPEC GKSFSSKKHLAEHQRTHTGEKPY KCPECGKSFSRSDHLTNHQRTHT GEKPYKCPECGKSFSSKKHLAEH QRTHTGEKPYKCPECGKSFSTTG NLTVHQRTHTGEKPYKCPECGKS FSQNSTLTEHQRTHTGEKPTGKK TS | 1937 | $X_1X_2X_3X_4X_5X_6X_7X_8X_9CX_{10}X_{11}CX_{12}X_{13}X_{14}X_{15}X_{16}$RRDELNVH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$RADNLTEH$X_{17}X_{18}$ $X_{19}$H$X_{20}X_{21}X_{22}X_{23}X_{24}X_8X_9CX_{10}X_{11}CX_{12}X_{13}X_{14}X_{15}X_{16}$SKKHLAEH$X_{17}$ $X_{18}X_{19}$H$X_{20}X_{21}X_{22}X_{23}X_{24}X_8X_9CX_{10}X_{11}CX_{12}X_{13}X_{14}X_{15}X_{16}$RSDHLTNH $X_{17}X_{18}X_{19}$H$X_{20}X_{21}X_{22}X_{23}X_{24}X_8X_9CX_{10}X_{11}CX_{12}X_{13}X_{14}X_{15}X_{16}$SKKHLA EH$X_{17}X_{18}X_{19}$H$X_{20}X_{21}X_{22}X_{23}X_{24}X_8X_9CX_{10}X_{11}CX_{12}X_{13}X_{14}X_{15}X_{16}$TTGN LTVH$X_{17}X_{18}X_{19}$H$X_{20}X_{21}X_{22}X_{23}X_{24}X_8X_9CX_{10}X_{11}CX_{12}XEX_{14}X_{15}X_{16}$QN STLTEH$X_{17}X_{18}X_{19}$H$X_{20}X_{21}X_{22}X_{23}X_{24}X_{25}X_{26}X_{27}X_{28}X_{29}X_{30}$ | 2486 |
| aatcccagg cccagatg cca | 1389 | AAT CCC AGG CCC AGA TGC CCA | LEPGEKPYKCPECGKSFSTSHSL TEHQRTHTGEKPYKCPECGKSFS RRDELNVHQRSRADNLTEHQRTHTGEKPY KCPECGKSFSSKKHLAEHQRTHT GEKPYKCPECGKSFSRSDHLTNH QRTHTGEKPYKCPECGKSFSSKK HLAEHQRTHTGEKPYKCPECGKS FSTTGNLTVHQRTHTGEKPTGKK TS | 1938 | $X_1X_2X_3X_4X_5X_6X_7X_8X_9CX_{10}X_{11}CX_{12}X_{13}X_{14}X_{15}X_{16}$TSHSLTEH$X_{17}X_{18}X_{19}$ H$X_{20}X_{21}X_{22}X_{23}X_{24}X_8X_9CX_{10}X_{11}CX_{12}X_{13}X_{14}X_{15}X_{16}$RRDELNVH$X_{17}X_{18}$ $X_{19}$H$X_{20}X_{21}X_{22}X_{23}X_{24}X_8X_9CX_{10}X_{11}CX_{12}X_{13}X_{14}X_{15}X_{16}$RADNLTEH$X_{17}$ $X_{18}X_{19}$H$X_{20}X_{21}X_{22}X_{23}X_{24}X_8X_9CX_{10}X_{11}CX_{12}X_{13}X_{14}X_{15}X_{16}$SKKHLAEH $X_{17}X_{18}X_{19}$H$X_{20}X_{21}X_{22}X_{23}X_{24}X_8X_9CX_{10}X_{11}CX_{12}X_{13}X_{14}X_{15}X_{16}$RSDHLT NH$X_{17}X_{18}X_{19}$H$X_{20}X_{21}X_{22}X_{23}X_{24}X_8X_9CX_{10}X_{11}CX_{12}X_{13}X_{14}X_{15}X_{16}$SKKH LAEH$X_{17}X_{18}X_{19}$H$X_{20}X_{21}X_{22}X_{23}X_{24}X_8X_9CX_{10}X_{11}CX_{12}X_{13}X_{14}X_{15}X_{16}$TT GNLTVH$X_{17}X_{18}X_{19}$H$X_{20}X_{21}X_{22}X_{23}X_{24}X_{25}X_{26}X_{27}X_{28}X_{29}X_{30}$ | 2487 |

TABLE 10-continued

| Column 1 Nucleotide Sequence of Target Site in HNF4α Expression Control Region | Column 2 Target sequence | Column 3 Target sequence with space | Column 4 Amino acid Sequence of Zinc Finger DNA Binding Domain Polypeptides Targeting the Target Site in Column 1 | Column 5 SEQ ID NO. (corresponds to sequences in Columns 1 and 3) | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| caggcccca gatgccaat ctt | | CAG GCC CCA GAT GCC AAT CTT | LEPGEKPYKCPECGKSFSTTGAL TEHQRTHTGEKPYKCPECGKSFS TTGNLTVHQRTHTGEKPYKCPEC GKSFSDCRDLARHQRTHTGEKPY KCPECGKSFSTSGNLVRHQRTHT GEKPYKCPECGKSFSTSHSLTEH QRTHTGEKPYKCPECGKSFSDCR DLARHQRTHTGEKPYKCPECGKS FSRADNLTEHQRTHTGEKPTGKK TS | 1390 | $X_1X_2X_3X_4X_5X_6X_7X_8X_9CX_{10}X_{11}CX_{12}X_{13}X_{14}X_{15}X_{16}TTGALTEHX_{17}X_{18}X_{19}HX_{20}X_{21}X_{22}X_{23}X_{24}X_8X_9CX_{10}X_{11}CX_{12}X_{13}X_{14}X_{15}X_{16}TTGNLTVHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLVRH X_{17}X_{18}X_{19}HX_{20}X_{21}X_{22}X_{23}X_{24}X_8X_9CX_{10}X_{11}CX_{12}X_{13}X_{14}X_{15}X_{16}TSHSLT EHX_{17}X_{18}X_{19}HX_{20}X_{21}X_{22}X_{23}X_{24}X_8X_9CX_{10}X_{11}CX_{12}X_{13}X_{14}X_{15}X_{16}DCRD LARHX_{17}X_{18}X_{19}HX_{20}X_{21}X_{22}X_{23}X_{24}X_8X_9CX_{10}X_{11}CX_{12}X_{13}X_{14}X_{15}X_{16}RA DNLTEHX_{17}X_{18}X_{19}HX_{20}X_{21}X_{22}X_{23}X_{24}X_{25}X_{26}X_{27}X_{28}X_{29}X_{30}$ | 2488 |
| gatgccaat cttctggat cct | | GAT GCC AAT CTT CTG GAT CCT | LEPGEKPYKCPECGKSFSTKNSL TEHQRTHTGEKPYKCPECGKSFS TSGNLVRHQRTHTGEKPYKCPEC GKSFSRNDALTEHQRTHTGEKPY KCPECGKSFSTTGALTEHQRTHT GEKPYKCPECGKSFSTTGNLTVH QRTHTGEKPYKCPECGKSFSDCR DLARHQRTHTGEKPYKCPECGKS FSTSGNLVRHQRTHTGEKPTGKK TS | 1391 | $X_1X_2X_3X_4X_5X_6X_7X_8X_9CX_{10}X_{11}CX_{12}X_{13}X_{14}X_{15}X_{16}TKNSLTEHX_{17}X_{18}X_{19}HX_{20}X_{21}X_{22}X_{23}X_{24}X_8X_9CX_{10}X_{11}CX_{12}X_{13}X_{14}X_{15}X_{16}TSGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}TTGALTEH X_{17}X_{18}X_{19}HX_{20}X_{21}X_{22}X_{23}X_{24}X_8X_9CX_{10}X_{11}CX_{12}X_{13}X_{14}X_{15}X_{16}TTGNLT VHX_{17}X_{18}X_{19}HX_{20}X_{21}X_{22}X_{23}X_{24}X_8X_9CX_{10}X_{11}CX_{12}X_{13}X_{14}X_{15}X_{16}DCRD LARHX_{17}X_{18}X_{19}HX_{20}X_{21}X_{22}X_{23}X_{24}X_8X_9CX_{10}X_{11}CX_{12}X_{13}X_{14}X_{15}X_{16}TS GNLVRHX_{17}X_{18}X_{19}HX_{20}X_{21}X_{22}X_{23}X_{24}X_{25}X_{26}X_{27}X_{28}X_{29}X_{30}$ | 2489 |
| gccccagat gccaatctt ctg | | GCC CCA GAT GCC AAT CTT CTG | LEPGEKPYKCPECGKSFSRNDAL TEHQRTHTGEKPYKCPECGKSFS TTGALTEHQRTHTGEKPYKCPEC GKSFSTTGNLTVHQRTHTGEKPY KCPECGKSFSDCRDLARHQRTHT GEKPYKCPECGKSFSTSGNLVRH QRTHTGEKPYKCPECGKSFSTSH SLTEHQRTHTGEKPYKCPECGKS FSDCRDLARHQRTHTGEKPTGKK TS | 1392 | $X_1X_2X_3X_4X_5X_6X_7X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}TTGALTEHX_{17}X_{18}X_{19}HX_{20}X_{21}X_{22}X_{23}X_{24}X_8X_9CX_{10}X_{11}CX_{12}X_{13}X_{14}X_{15}X_{16}TTGNLTVHX_{17}X_{18}X_{19}HX_{20}X_{21}X_{22}X_{23}X_{24}X_8X_9CX_{10}X_{11}CX_{12}X_{13}X_{14}X_{15}X_{16}DCRDLARH X_{17}X_{18}X_{19}HX_{20}X_{21}X_{22}X_{23}X_{24}X_8X_9CX_{10}X_{11}CX_{12}X_{13}X_{14}X_{15}X_{16}TSGNLV RHX_{17}X_{18}X_{19}HX_{20}X_{21}X_{22}X_{23}X_{24}X_8X_9CX_{10}X_{11}CX_{12}X_{13}X_{14}X_{15}X_{16}TSHS LTEHX_{17}X_{18}X_{19}HX_{20}X_{21}X_{22}X_{23}X_{24}X_8X_9CX_{10}X_{11}CX_{12}X_{13}X_{14}X_{15}X_{16}DC RDLARHX_{17}X_{18}X_{19}HX_{20}X_{21}X_{22}X_{23}X_{24}X_{25}X_{26}X_{27}X_{28}X_{29}X_{30}$ | 2490 |
| ccagatgcc aatctctg gat | | CCA GAT GCC AAT CTT CTG GAT | LEPGEKPYKCPECGKSFSTSGNL VRHQRTHTGEKPYKCPECGKSFS RNDALTEHQRTHTGEKPYKCPEC GKSFTTGALTEHQRTHTGEKPY KCPECGKSFSTTGNLTVHQRTHT GEKPYKCPECGKSFSDCRDLARH QRTHTGEKPYKCPECGKSFSTSG NLVRHQRTHTGEKPYKCPECGKS FSTSHSLTEHQRTHTGEKPTGKK TS | 1393 | $X_1X_2X_3X_4X_5X_6X_7X_8X_9CX_{10}X_{11}CX_{12}X_{13}X_{14}X_{15}X_{16}TSGNLVRHX_{17}X_{18}X_{19}HX_{20}X_{21}X_{22}X_{23}X_{24}X_8X_9CX_{10}X_{11}CX_{12}XEX_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}TTGALTEHX_{17}X_{18}X_{19}HX_{20}X_{21}X_{22}X_{23}X_{24}X_8X_9CX_{10}X_{11}CX_{12}X_{13}X_{14}X_{15}X_{16}TTGNLTVH X_{17}X_{18}X_{19}HX_{20}X_{21}X_{22}X_{23}X_{24}X_8X_9CX_{10}X_{11}CX_{12}X_{13}X_{14}X_{15}X_{16}DCRDLA RHX_{17}X_{18}X_{19}HX_{20}X_{21}X_{22}X_{23}X_{24}X_8X_9CX_{10}X_{11}CX_{12}X_{13}X_{14}X_{15}X_{16}TSGN LVRHX_{17}X_{18}X_{19}HX_{20}X_{21}X_{22}X_{23}X_{24}X_8X_9CX_{10}X_{11}CX_{12}X_{13}X_{14}X_{15}X_{16}TS HSLTEHX_{17}X_{18}X_{19}HX_{20}X_{21}X_{22}X_{23}X_{24}X_{25}X_{26}X_{27}X_{28}X_{29}X_{30}$ | 2491 |

TABLE 10-continued

| Column 1 Nucleotide Sequence of Target Site in HNF4α Expression Control Region | Column 2 Target sequence with space | Column 3 SEQ ID NO. (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| ctggagcagaatggactgga | CTG GGA GCA GAA TGG ACT GGA | 1394 | LEPGEKPYKCPECGKSFSQRAHLERHQRTHTGEKPYKCPECGKSFSTHLDLIRHQRTHTGEKPYKCPECGKSFSRSDHLTTHQRTHTGEKPYKCPECGKSFSQSSNLVRHQRTHTGEKPYKCPECGKSFSQSGDLRRHQRTHTGEKPYKCPECGKSFSQRAHLERHQRTHTGEKPYKCPECGKSFSRNDALTEHQRTHTGEKPTGKKTS | 1943 | $X_1X_2X_3X_4X_5X_6X_7X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}THLDLIRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}QSSNLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{25}X_{26}Z_7X_{28}X_{29}X_{30}$ | 2492 |
| cccctggagcagaatggact | CCC CTG GGA GCA GAA TGG ACT | 1395 | LEPGEKPYKCPECGKSFSTHLDLIRHQRTHTGEKPYKCPECGKSFSRSDHLTTHQRTHTGEKPYKCPECGKSFSQSSNLVRHQRTHTGEKPYKCPECGKSFSQSGDLRRHQRTHTGEKPYKCPECGKSFSQRAHLERHQRTHTGEKPYKCPECGKSFSRNDALTEHQRTHTGEKPYKCPECGKSFSSKKHLAEHQRTHTGEKPTGKKTS | 1944 | $X_1X_2X_3X_4X_5X_6X_7X_8X_9CX_{10}X_{11}CX_{12}X_{13}X_{14}X_{15}X_{16}THLDLIRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}QSSNLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{25}X_{26}X_{27}X_{28}X_{29}X_{30}$ | 2493 |
| ggagcagaatggactggaagt | GGA GCA GAA TGG ACT GGA AGT | 1396 | LEPGEKPYKCPECGKSFSHRTTLTNHQRTHTGEKPYKCPECGKSFSQRAHLERHQRTHTGEKPYKCPECGKSFSTHLDLIRHQRTHTGEKPYKCPECGKSFSRSDHLTTHQRTHTGEKPYKCPECGKSFSQSSNLVRHQRTHTGEKPYKCPECGKSFSQSGDLRRHQRTHTGEKPYKCPECGKSFSQRAHLERHQRTHTGEKPTGKKTS | 1945 | $X_1X_2X_3X_4X_5X_6X_7X_8X_9CX_{10}X_{11}CX_{12}X_{13}X_{14}X_{15}X_{16}HRTTLTNHX_{17}X_{18}X_{19}HX_{20}X_{21}X_{22}X_{23}X_{24}X_8X_9CX_{10}X_{11}CX_{12}XEX_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}THLDLIRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}QSSNLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_{25}X_{26}X_{27}X_{28}X_{29}X_{30}$AHLERHX$_{17}$X$_{18}$X$_{19}$HX$_{20}$X$_{21}$X$_{22}$X$_{23}$X$_{24}$X$_{25}$X$_{26}$X$_{27}$X$_{28}$X$_{29}$X$_{30}$ | 2494 |
| gttcccctgggagcagaatgg | GTT CCC CTG GGA GCA GAA TGG | 1397 | LEPGEKPYKCPECGKSFSRSDHLTTHQRTHTGEKPYKCPECGKSFSQSSNLVRHQRTHTGEKPYKCPECGKSFSQSGDLRRHQRTHTGEKPYKCPECGKSFSQRAHLERHQRTHTGEKPYKCPECGKSFSRNDALTEHQRTHTGEKPYKCPECGKSSKKHLAEHQRTHTGEKPYKCPECGKSFSTSGSLVRHQRTHTGEKPTGKKTS | 1946 | $X_1X_2X_3X_4X_5X_6X_7X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}QSSNLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSGDLRRHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLERHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEHX_{17}X_{18}X_{19}HX_{20}X_{21}X_{22}X_{23}X_{24}X_8X_9CX_{10}X_{11}CX_{12}X_{13}X_{14}X_{15}X_{16}SKKHLAEHX_{17}X_{18}X_{19}HX_{20}X_{21}X_{22}X_{23}X_{24}X_8X_9CX_{10}X_{11}CX_{12}X_{13}X_{14}X_{15}X_{16}TSGSLVRHX_{17}X_{18}X_{19}HX_{20}X_{21}X_{22}X_{23}X_{25}X_{26}X_{27}X_{28}X_{29}X_{30}$ | 2495 |

TABLE 10-continued

| Column 1 Nucleotide Sequence of Target Site in HNF4α Expression Control Region | Column 3 Target sequence with space | Column 2 SEQ ID NO. (corresponds to sequences in Columns 1 and 3) | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| ccggtccc ctgggagca gaa | CCG GTT CCC TGG GGA GCA GAA | 1398 | LEPGEKPYKCPECGKSFSQSSNL VRHQRTHTGEKPYKCPECGKSFS QSGDLRRHQRTHTGEKPYKCPEC GKSFSQRAHLERHQRTHTGEKPY KCPECGKSFSRNDALTEHQRTHT GEKPYKCPECGKSSKKHLAEH QRTHTGEKPYKCPECGKSFSTSG SLVRHQRTHTGEKPYKCPECGKS FSRNDTLTEHQRTHTGEKPTGKK TS | 1947 | $X_1X_2X_3X_4X_5X_6X_7X_8X_9CX_{10}X_{11}CX_{12}X_{13}X_{14}X_{15}X_{16}$QSSNLVRH$X_{17}X_{18}X_{19}$H$X_{20}X_{21}X_{22}X_{23}X_{24}X_8X_9CX_{10}X_{11}CX_{12}X_{13}X_{14}X_{15}X_{16}$QSGDLRRH$X_{17}X_{18}$X_{19}$HX_{20}X_{21}X_{22}X_{23}X_{24}X_8X_9CX_{10}X_{11}CX_{12}X_{13}X_{14}X_{15}X_{16}$QRAHLERH$X_{17}$X_{18}X_{19}HX_{20}X_{21}X_{22}X_{23}X_{24}X_8X_9CX_{10}X_{11}CX_{12}X_{13}X_{14}X_{15}X_{16}$RNDALTEH$X_{17}X_{18}X_{19}HX_{20}X_{21}X_{22}X_{23}X_{24}X_8X_9CX_{10}X_{11}CX_{12}X_{13}X_{14}X_{15}X_{16}$SKKHLAEH$X_{17}X_{18}X_{19}HX_{20}X_{21}X_{22}X_{23}X_{24}X_8X_9CX_{10}X_{11}CX_{12}X_{13}X_{14}X_{15}X_{16}$TSGSLVRH$X_{17}X_{18}X_{19}HX_{20}X_{21}X_{22}X_{23}X_{24}X_8X_9CX_{10}X_{11}CX_{12}X_{13}X_{14}X_{15}X_{16}$RNDTLTEH$X_{17}X_{13}X_{19}HX_{20}X_{21}X_{22}X_{23}X_{24}X_{25}X_{26}X_{27}X_{28}X_{29}X_{30}$ | 2496 |
| tgggagcag aatgactg gaa | TGG gag CAG AAT GGA CTG GAA | 1399 | LEPGEKPYKCPECGKSFSQSSNL VRHQRTHTGEKPYKCPECGKSFS RNDALTEHQRTHTGEKPYKCPEC GKSFSQRAHLERHQRTHTGEKPY KCPECGKSFSTTGNLTVHQRTHT GEKPYKCPECGKSFSRADNLTEH QRTHTGEKPYKCPECGKSFSRSD NLVRHQRTHTGEKPYKCPECGKS FSRSDHLTTHQRTHTGEKPTGKK TS | 1948 | $X_1X_2X_3X_4X_5X_6X_7X_8X_9CX_{10}X_{11}CX_{12}X_{13}X_{14}X_{15}X_{16}$QSSNLVRH$X_{17}X_{18}X_{19}$H$X_{20}X_{21}X_{22}X_{23}X_{24}X_8X_9CX_{10}X_{11}CX_{12}X_{13}X_{14}X_{15}X_{16}$RNDALTEH$X_{17}X_{18}X_{19}HX_{20}X_{21}X_{22}X_{23}X_{24}X_8X_9CX_{10}X_{11}CX_{12}X_{13}X_{14}X_{15}X_{16}$QRAHLERH$X_{17}X_{18}X_{19}HX_{20}X_{21}X_{22}X_{23}X_{24}X_8X_9CX_{10}X_{11}CX_{12}X_{13}X_{14}X_{15}X_{16}$TTGNLTVH$X_{17}X_{18}X_{19}HX_{20}X_{21}X_{22}X_{23}X_{24}X_8X_9CX_{10}X_{11}CX_{12}X_{13}X_{14}X_{15}X_{16}$RADNLTEH$X_{17}X_{18}X_{19}HX_{20}X_{21}X_{22}X_{23}X_{24}X_8X_9CX_{10}X_{11}CX_{12}X_{13}X_{14}X_{15}X_{16}$RSDNLVRH$X_{17}X_{18}X_{19}HX_{20}X_{21}X_{22}X_{23}X_{24}X_8X_9CX_{10}X_{11}CX_{12}X_{13}X_{14}X_{15}X_{16}$RSDHLTTH$X_{17}X_{18}X_{19}HX_{20}X_{21}X_{22}X_{23}X_{24}X_{25}X_{26}X_{27}X_{28}X_{29}X_{30}$ | 2497 |
| ccctgggag cagaatgga ctg | CCC TGG gag AAT GGA CTG | 1400 | LEPGEKPYKCPECGKSFSRNDAL TEHQRTHTGEKPYKCPECGKSFS QRAHLERHQRTHTGEKPYKCPEC GKSFSTTGNLTVHQRTHTGEKPY KCPECGKSFSRADNLTEHQRTHT GEKPYKCPECGKSFSRSDNLVRH QRTHTGEKPYKCPECGKSFSRSD HLTTHQRTHTGEKPYKCPECGKS FSSKKHLAEHQRTHTGEKPTGKK TS | 1949 | $X_1X_2X_3X_4X_5X_6X_7X_8X_9CX_{10}X_{11}CX_{12}X_{13}X_{14}X_{15}X_{16}$RNDALTEH$X_{17}X_{18}X_{19}$H$X_{20}X_{21}X_{22}X_{23}X_{24}X_8X_9CX_{10}X_{11}CX_{12}X_{13}X_{14}X_{15}X_{16}$QRAHLERH$X_{17}X_{18}$X_{19}HX_{20}X_{21}X_{22}X_{23}X_{24}X_8X_9CX_{10}X_{11}CX_{12}X_{13}X_{14}X_{15}X_{16}$TTGNLTVH$X_{17}X_{18}X_{19}HX_{20}X_{21}X_{22}X_{23}X_{24}X_8X_9CX_{10}X_{11}CX_{12}X_{13}X_{14}X_{15}X_{16}$RADNLTEH$X_{17}X_{18}X_{19}HX_{20}X_{21}X_{22}X_{23}X_{24}X_8X_9CX_{10}X_{11}CX_{12}X_{13}X_{14}X_{15}X_{16}$RSDNLVRH$X_{17}X_{18}X_{19}HX_{20}X_{21}X_{22}X_{23}X_{24}X_8X_9CX_{10}X_{11}CX_{12}X_{13}X_{14}X_{15}X_{16}$RSDHLTTH$X_{17}X_{18}X_{19}HX_{20}X_{21}X_{22}X_{23}X_{24}X_8X_9CX_{10}X_{11}CX_{12}X_{13}X_{14}X_{15}X_{16}$SKKHLAEH$X_{17}X_{18}X_{19}HX_{20}X_{21}X_{22}X_{23}X_{24}X_{25}X_{26}X_{27}X_{28}X_{29}X_{30}$ | 2498 |
| ctgaagtt tgggagggc cag | CTG GAA GTT TGG GAG GGC CAG | 1401 | LEPGEKPYKCPECGKSFSRADNL TEHQRTHTGEKPYKCPECGKSFS DPGHLVRHQRTHTGEKPYKCPEC GKSFSRSDNLVRHQRTHTGEKPY KCPECGKSFSTSGSLVRH QRTHTGEKPYKCPECGKSFSQSS NLVRHQRTHTGEKPYKCPECGKS FSRNDALTEHQRTHTGEKPTGKK TS | 1950 | $X_1X_2X_3X_4X_5X_6X_7X_8X_9CX_{10}X_{11}CX_{12}X_{13}X_{14}X_{15}X_{16}$RADNLTEH$X_{17}X_{18}X_{19}$H$X_{20}X_{21}X_{22}X_{23}X_{24}X_8X_9CX_{10}X_{11}CX_{12}X_{13}X_{14}X_{15}X_{16}$DPGHLVRH$X_{17}X_{18}$X_{19}HX_{20}X_{21}X_{22}X_{23}X_{24}X_8X_9CX_{10}X_{11}CX_{12}X_{13}X_{14}X_{15}X_{16}$RSDNLVRH$X_{17}$X_{18}X_{19}HX_{20}X_{21}X_{22}X_{23}X_{24}X_8X_9CX_{10}X_{11}CX_{12}X_{13}X_{14}X_{15}X_{16}$TSGSLVRH$X_{17}X_{18}X_{19}HX_{20}X_{21}X_{22}X_{23}X_{24}X_8X_9CX_{10}X_{11}CX_{12}X_{13}X_{14}X_{15}X_{16}$QSSNLVRH$X_{17}X_{18}X_{19}HX_{20}X_{21}X_{22}X_{23}X_{24}X_8X_9CX_{10}X_{11}CX_{12}X_{13}X_{14}X_{15}X_{16}$RNDALTEH$X_{17}X_{18}X_{19}HX_{20}X_{21}X_{22}X_{23}X_{24}X_{25}X_{26}X_{27}X_{28}X_{29}X_{30}$ | 2499 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| gaagtttgg gagggccag att | 1402 | GAA GTT TGG GAG GGC CAG ATT | LEPGEKPYKCPECGKSFSHKNAL QNHQRTHTGEKPYKCPECGKSFS RADNLTEHQRTHTGEKPYKCPEC GKSFSDPGHLVRHQRTHTGEKPY KCPECGKSFSRSDNLVRHQRTHT GEKPYKCPECGKSFSRSDHLTTH QRTHTGEKPYKCPECGKSFSTSG SLVRHQRTHTGEKPYKCPECGKS FSQSSNLVRHQRTHTGEKPTGKK TS | 1951 | $X_1X_2X_3X_4X_5X_6X_7X_8X_9CX_{10}X_{11}CX_{12}X_{13}X_{14}X_{15}X_{16}$HKNALQNH$X_{17}X_{18}X_{19}$H$X_{20}X_{21}X_{22}X_{23}X_{24}X_8X_9$C$X_{10}X_{11}$C$X_{12}$XE$X_{14}X_{15}X_{16}$RADNLTEH$X_{17}X_{18}$ $X_{19}$H$X_{20}X_{21}X_{22}X_{23}X_{24}X_8X_9$C$X_{10}X_{11}$C$X_{12}X_{13}X_{14}X_{15}X_{16}$DPGHLVRH$X_{17}$ $X_{18}X_{19}$H$X_{20}X_{21}X_{22}X_{23}X_{24}X_8X_9$C$X_{10}X_{11}$C$X_{12}X_{13}X_{14}X_{15}X_{16}$RSDNLVRH $X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$RSDHLT THX$_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$TSGS LVRH$X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$QS SNLVRH$X_{17}X_{18}X_{19}$H$X_{20}X_{21}X_{22}X_{23}X_{24}X_{25}X_{26}X_{27}X_{28}X_{29}X_{30}$ | 2500 |
| gtttgggag ggccagatt cac | 1403 | GTT TGG GAG GGC CAG ATT CAC | LEPGEKPYKCPECGKSFSSKKAL TEHQRTHTGEKPYKCPECGKSFS HKNALQNHQRTHTGEKPYKCPEC GKSFSRADNLTEHQRTHTGEKPY KCPECGKSFSDPGHLVRHQRTHT GEKPYKCPECGKSFSRSDNLVRH QRTHTGEKPYKCPECGKSFSRSD HLTTHQRTHTGEKPYKCPECGKS FSTSGSLVRHQRTHTGEKPTGKK TS | 1952 | $X_1X_2X_3X_4X_5X_6X_7X_8X_9$C$X_{10}X_{11}$C$X_{12}X_{13}X_{14}X_{15}X_{16}$TSGSLVRH$X_{17}X_{18}X_{19}$ H$X_{20}X_{21}X_{22}X_{23}X_{24}X_8X_9$C$X_{10}X_{11}$C$X_{12}X_{13}X_{14}X_{15}X_{16}$QSSNLVRH$X_{17}X_{18}$ $X_{19}$H$X_{20}X_{21}X_{22}X_{23}X_{24}X_8X_9$C$X_{10}X_{11}$C$X_{12}X_{13}X_{14}X_{15}X_{16}$RNDALTEH$X_{17}$ $X_{18}X_{19}$H$X_{20}X_{21}X_{22}X_{23}X_{24}X_8X_9$C$X_{10}X_{11}$C$X_{12}X_{13}X_{14}X_{15}X_{16}$QRAHLERH $X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$RSDNLV RH$X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$RSDH LTTH$X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$TS GSLVRH$X_{17}X_{18}X_{19}$H$X_{20}X_{21}X_{22}X_{23}X_{24}X_{25}X_{26}X_{27}X_{28}X_{29}X_{30}$ | 2501 |
| gagcagaat ggactggaa gtt | 1404 | gag CAG AAT GGA CTG GAA GTT | LEPGEKPYKCPECGKSFSTSGSL VRHQRTHTGEKPYKCPECGKSFS QSSNLVRHQRTHTGEKPYKCPEC GKSFSRNDALTEHQRTHTGEKPY KCPECGKSFSQRAHLERHQRTHT GEKPYKCPECGKSFSTTGNLTVH QRTHTGEKPYKCPECGKSFSRAD NLTEHQRTHTGEKPYKCPECGKS FSRSDNLVRHQRTHTGEKPTGKK TS | 1953 | $X_1X_2X_3X_4X_5X_6X_7X_8X_9$C$X_{10}X_{11}$C$X_{12}X_{13}X_{14}X_{15}X_{16}$TSGSLVRH$X_{17}X_{18}X_{19}$ H$X_{20}X_{21}X_{22}X_{23}X_{24}X_8X_9$C$X_{10}X_{11}$C$X_{12}X_{13}X_{14}X_{15}X_{16}$QSSNLVRH$X_{17}X_{18}$ $X_{19}$H$X_{20}X_{21}X_{22}X_{23}X_{24}X_8X_9$C$X_{10}X_{11}$C$X_{12}X_{13}X_{14}X_{15}X_{16}$RNDALTEH$X_{17}$ $X_{18}X_{19}$H$X_{20}X_{21}X_{22}X_{23}X_{24}X_8X_9$C$X_{10}X_{11}$C$X_{12}X_{13}X_{14}X_{15}X_{16}$QRAHLERH $X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$TTGNLT VH$X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$RADN LTEH$X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$RS DNLVRH$X_{17}X_{18}X_{19}$H$X_{20}X_{21}X_{22}X_{23}X_{24}X_{25}X_{26}X_{27}X_{28}X_{29}X_{30}$ | 2502 |
| aatgactg gaagtttgg gag | 1405 | AAT GGA CTG GAA GTT TGG GAG | LEPGEKPYKCPECGKSFSRSDNL VRHQRTHTGEKPYKCPECGKSFS RSDHLTTHQRTHTGEKPYKCPEC GKSFSTSGSLVRHQRTHTGEKPY KCPECGKSFSQSSNLVRHQRTHT GEKPYKCPECGKSFSRNDALTEH QRTHTGEKPYKCPECGKSFSQRA HLERHQRTHTGEKPYKCPECGKS FSTTGNLTVHQRTHTGEKPTGKK TS | 1954 | $X_1X_2X_3X_4X_5X_6X_7X_8X_9$C$X_{10}X_{11}$C$X_{12}X_{13}X_{14}X_{15}X_{16}$RSDNLVRH$X_{17}X_{18}X_{19}$ H$X_{20}X_{21}X_{22}X_{23}X_{24}X_8X_9$C$X_{10}X_{11}$C$X_{12}X_{13}X_{14}X_{15}X_{16}$RSDHLTTH$X_{17}X_{18}$ $X_{19}$H$X_{20}X_{21}X_{22}X_{23}X_{24}X_8X_9$C$X_{10}X_{11}$C$X_{12}X_{13}X_{14}X_{15}X_{16}$TSGSLVRH $X_{18}X_{19}$H$X_{20}X_{21}X_{22}X_{23}X_{24}X_8X_9$C$X_{10}X_{11}$C$X_{12}X_{13}X_{14}X_{15}X_{16}$QSSNLVRH $X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$RNDALT EH$X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$QRAH LERH$X_{17}X_{18}X_{19}$H$X_{20}X_{21}X_{22}X_{23}X_{24}X_8X_9$C$X_{10}X_{11}$C$X_{12}X_{13}X_{14}X_{15}X_{16}$TT GNLTVH$X_{17}X_{18}X_{19}$H$X_{20}X_{21}X_{22}X_{23}X_{24}X_{25}X_{26}X_{27}X_{28}X_{29}X_{30}$ | 2503 |

TABLE 10-continued

| Column 1 Nucleotide Sequence of Target Site in HNF4α Expression Control Region | Column 2 SEQ ID NO. (corresponds to sequences in Columns 1 and 3) | Column 3 Target sequence with space | Column 4 Amino acid Sequence of Zinc Finger DNA Binding Domain Polypeptides Targeting the Target Site in Column 1 | Column 5 SEQ ID NO: | Column 6 Amino Acid Sequence Structure of Zinc Finger DNA Binding Domain Polypeptides Targeting the Target Site in Column 1 (see Table 1B above and description thereof) | Column 7 SEQ ID NO: |
|---|---|---|---|---|---|---|
| ggactggaa gtttgggag ggc | 1406 | GGA CTG GAA GTT TGG GAG GGC | LEPGEKPYKCPECGKSFSDPGHL VRHQRTHTGEKPYKCPECGKSFS RSDNLVRHQRTHTGEKPYKCPEC GKSFSRSDHLTTHQRTHTGEKPY KCPECGKSFSTSGSLVRHQRTHT GEKPYKCPECGKSFSQSSNLVRH QRTHTGEKPYKCPECGKSFSRND ALTEHQRTHTGEKPYKCPECGKS FSQRAHLERHQRTHTGEKPTGKK TS | 1955 | $X_1X_2X_3X_4X_5X_6X_7X_8X_9CX_{10}X_{11}CX_{12}X_{13}X_{14}X_{15}X_{16}DPGHLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}TSGSLVRH X_{17}X_{18}X_{19}HX_{20}X_{21}X_{22}X_{23}X_{24}X_8X_9CX_{10}X_{11}CX_{12}X_{13}X_{14}X_{15}X_{16}QSSNLV RHX_{17}X_{18}X_{19}HX_{20}X_{21}X_{22}X_{23}X_{24}X_8X_9CX_{10}X_{11}CX_{12}X_{13}X_{14}X_{15}X_{16}RNDA LTEHX_{17}X_{18}X_{19}HX_{20}X_{21}X_{22}X_{23}X_{24}X_8X_9CX_{10}X_{11}CX_{12}XEX_{14}X_{15}X_{16}QR AHLERHX_{17}X_{18}X_{19}HX_{20}X_{21}X_{22}X_{23}X_{24}X_{25}X_{26}X_{27}X_{28}X_{29}X_{30}$ | 2504 |
| cagaatgga ctggaagtt tgg | 1407 | CAG AAT GGA CTG GAA GTT TGG | LEPGEKPYKCPECGKSFSRSDHL TTHQRTHTGEKPYKCPECGKSFS TSGSLVRHQRTHTGEKPYKCPEC GKSFSQSSNLVRHQRTHTGEKPY KCPECGKSFSRNDALTEHQRTHT GEKPYKCPECGKSFSQRAHLERH QRTHTGEKPYKCPECGKSFSTTG NLTVHQRTHTGEKPYKCPECGKS FSRADNLTEHQRTHTGEKPTGKK TS | 1956 | $X_1X_2X_3X_4X_5X_6X_7X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}TSGSLVRHX_{17}X_{18}X_{19}HX_{20}X_{21}X_{22}X_{23}X_{24}X_8X_9CX_{10}X_{11}CX_{12}X_{13}X_{14}X_{15}X_{16}QSSNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RNDALTEH RHX_{17}X_{18}X_{19}HX_{20}X_{21}X_{22}X_{23}X_{24}X_8X_9CX_{10}X_{11}CX_{12}X_{13}X_{14}X_{15}X_{16}QRAHLE RHX_{17}X_{18}X_{19}HX_{20}X_{21}X_{22}X_{23}X_{24}X_8X_9CX_{10}X_{11}CX_{12}X_{13}X_{14}X_{15}X_{16}TTGN LTVHX_{17}X_{18}X_{19}HX_{20}X_{21}X_{22}X_{23}X_{24}X_8X_9CX_{10}X_{11}CX_{12}X_{13}X_{14}X_{15}X_{16}RA DNLTEHX_{17}X_{18}X_{19}HX_{20}X_{21}X_{22}X_{23}X_{24}X_{25}X_{26}X_{27}X_{28}X_{29}X_{30}$ | 2505 |
| cctgggagc agaatggac tgg | 1408 | CCT ggg AGC AGA ATG GAC TGG | LEPGEKPYKCPECGKSFSRSDHL TTHQRTHTGEKPYKCPECGKSFS DPGNLVRHQRTHTGEKPYKCPEC GKSFSRRDELNVHQRTHTGEKPY KCPECGKSFSQLAHLRAHQRTHT GEKPYKCPECGKSFSERSHLREH QRTHTGEKPYKCPECGKSFSRSD KLVRHQRTHTGEKPYKCPECGKS FSTKNSLTEHQRTHTGEKPTGKK TS | 1957 | $X_1X_2X_3X_4X_5X_6X_7X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}DPGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RRDELNVHX_{17}X_{18}X_{19}HX_{20}X_{21}X_{22}X_{23}X_{24}X_8X_9CX_{10}X_{11}CX_{12}X_{13}X_{14}X_{15}X_{16}QLAHLRAH X_{17}X_{18}X_{19}HX_{20}X_{21}X_{22}X_{23}X_{24}X_8X_9CX_{10}X_{11}CX_{12}X_{13}X_{14}X_{15}X_{16}ERSHLR EHX_{17}X_{18}X_{19}HX_{20}X_{21}X_{22}X_{23}X_{24}X_8X_9CX_{10}X_{11}CX_{12}X_{13}X_{14}X_{15}X_{16}RSDK LVRHX_{17}X_{18}X_{19}HX_{20}X_{21}X_{22}X_{23}X_{24}X_8X_9CX_{10}X_{11}CX_{12}X_{13}X_{14}X_{15}X_{16}TK NSLTEHX_{17}X_{18}X_{19}HX_{20}X_{21}X_{22}X_{23}X_{24}X_{25}X_{26}X_{27}X_{28}X_{29}X_{30}$ | 2506 |
| gggagcaga atggactgg aag | 1409 | ggg AGC AGA ATG GAC TGG AAG | LEPGEKPYKCPECGKSFSRKDNL KNHQRTHTGEKPYKCPECGKSFS RSDHLTTHQRTHTGEKPYKCPEC GKSFSDPGNLVRHQRTHTGEKPY KCPECGKSFSRRDELNVHQRTHT GEKPYKCPECGKSFSQLAHLRAH QRTHTGEKPYKCPECGKSFSERS HLREHQRTHTGEKPYKCPECGKS FSRSDKLVRHQRTHTGEKPTGKK TS | 1958 | $X_1X_2X_3X_4X_5X_6X_7X_8X_9CX_{10}X_{11}CX_{12}X_{13}X_{14}X_{15}X_{16}RKDNLKNHX_{17}X_{18}X_{19}HX_{20}X_{21}X_{22}X_{23}X_{24}X_8X_9CX_{10}X_{11}CX_{12}X_{13}X_{14}X_{15}X_{16}RSDHLTTHX_{17}X_{18}X_{19}HX_{20}X_{21}X_{22}X_{23}X_{24}X_8X_9CX_{10}X_{11}CX_{12}X_{13}X_{14}X_{15}X_{16}DPGNLVRHX_{17}X_{18}X_{19}HX_{20}X_{21}X_{22}X_{23}X_{24}X_8X_9CX_{10}X_{11}CX_{12}X_{13}X_{14}X_{15}X_{16}RRDELNVH X_{17}X_{18}X_{19}HX_{20}X_{21}X_{22}X_{23}X_{24}X_8X_9CX_{10}X_{11}CX_{12}X_{13}X_{14}X_{15}X_{16}QLAHLR AHX_{17}X_{18}X_{19}HX_{20}X_{21}X_{22}X_{23}X_{24}X_8X_9CX_{10}X_{11}CX_{12}X_{13}X_{14}X_{15}X_{16}ERSH LREHX_{17}X_{18}X_{19}HX_{20}X_{21}X_{22}X_{23}X_{24}X_8X_9CX_{10}X_{11}CX_{12}X_{13}X_{14}X_{15}X_{16}RS DKLVRHX_{17}X_{18}X_{19}HX_{20}X_{21}X_{22}X_{23}X_{24}X_{25}X_{26}X_{27}X_{28}X_{29}X_{30}$ | 2507 |

Informal Sequence Listing
>dCas9-VPR Protein

SEQ ID NO.: 95

MAPKKKRKVGIHGVPAADKKYSIGLAIGTNSVGWAVITDEYKVPSKKFKVLGNTDRHSIKKNLIGALLFDSGETAEATRLKRT
ARRRYTRRKNRICYLQEIFSNEMAKVDDSFFHRLEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENPINASGVDAKAILSARLSKSRRLENLIAQLPGEK
KNGLFGNLIALSLGLTPNFKSNFDLAEDAKLQLSKDTYDDDLDNLLAQIGDQYADLFLAAKNLSDAILLSDILRVNTEITKAP
LSASMIKRYDEHHQDLTLLKALVRQQLPEKYKEIFFDQSKNGYAGYIDGGASQEEFYKFIKPILEKMDGTEELLVKLNREDLL
RKQRTFDNGSIPHQIHLGELHAILRRQEDFYPFLKDNREKIEKILTFRIPYYVGPLARGNSRFAWMTRKSEETITPWNFEEVV
DKGASAQSFIERMTNFDKNLPNEKVLPKHSLLYEYFTVYNELTKVKYVTEGMRKPAFLSGEQKKAIVDLLFKTNRKVTVKQLK
EDYFKKIECFDSVEISGVEDRFNASLGTYHDLLKIIKDKDFLDNEENEDILEDIVLTLTLFEDREMIEERLKTYAHLFDDKVM
KQLKRRRYTGWGRLSRKLINGIRDKQSGKTILDFLKSDGFANRNFMQLIHDDSLTFKEDIQKAQVSGQGDSLHEHIANLAGSP
AIKKGILQTVKVVDELVKVMGRHKPENIVIEMARENQTTQKGQKNSRERMKRIEEGIKELGSQILKEHPVENTQLQNEKLYLY
YLQNGRDMYVDQELDINRLSDYDVAAIVPQSFLKDDSIDNKVLTRSDKARGKSDNVPSEEVVKKMKNYWRQLLNAKLITQRKF
DNLTKAERGGLSELDKAGFIKRQLVETRQITKHVAQILDSRMNTKYDENDKLIREVKVITLKSKLVSDFRKDFQFYKVREINN
YHHAHDAYLNAVVGTALIKKYPKLESEFVYGDYKVYDVRKMIAKSEQEIGKATAKYFFYSNIMNFFKTEITLANGEIRKRPLI
ETNGETGEIVWDKGRDFATVRKVLSMPQVNIVKKTEVQTGGFSKESILPKRNSDKLIARKKDWDPKKYGGFDSPTVAYSVLVV
AKVEKGKSKKLKSVKELLGITIMERSSFEKNPIDFLEAKGYKEVKKDLIIKLPKYSLFELENGRKRMLASAGELQKGNELALP
SKYVNFLYLASHYEKLKGSPEDNEQKQLFVEQHKHYLDEIIEQISEFSKRVILADANLDKVLSAYNKHRDKPIREQAENIIHL
FTLTNLGAPAAFKYFDTTIDRKRYTSTKEVLDATLIHQSITGLYETRIDLSQLGGDKRPAATKKAGQAKKKKGRADALDDFDL
DMLGSDALDDFDLDMLGSDALDDFDLDMLGSDALDDFDLDMLSGGPKKKRKVGSQYLPDTDDRHRIEEKRKRTYETFKSIMKK
SPFSGPTDPRPPPRRIAVPSRSSASVPKPAPQPYPFTSSLSTINYDEFPTMVFPSGQISQASALAPAPPQVLPQAPAPAPAPA
MVSALAQAPAPVPVLAPGPPQAVAPPAPKPTQAGEGTLSEALLQLQFDDEDLGALLGNSTDPAVFTDLASVDNSEFQQLLNQG
IPVAPHTTEPMLMEYPEAITRLVTGAQRPPDPAPAPLGAPGLPNGLLSGDEDFSSIADMDFSALLGSGSGSRDSREGMFLPKP
EAGSAISDVFEGREVCQPKRIRPFHPPGSPWANRPLPASLAPTPTGPVHEPVGSLTPAPVPQPLDPAPAVTPEASHLLEDPDE
ETSQAVKALREMADTVIPQKEEAAICGQMDLSHPPPRGHLDELTTTLESMTEDLNLDSPLTPELNEILDTFLNDECLLHAMHI
STGLSIFDTSLFSGGKRPAATKKAGQAKKKKGSYPYDVPDYA

>dCas9-VPR mRNA

SEQ ID NO.: 96

AGGAAAUAAGAGAGAAAAGAAGAGUAAGAAGAAAUAUAAGAGCCACCAUGGCCCCCAAGAAGAAGCGGAAGGUGGGCAUCCAC
GGCGUGCCCGCCGCCGACAAGAAGUACAGCAUCGGCCUGGCCAUCGGCACCAACAGCGUGGGCUGGGCCGUGAUCACCGACGA
GUACAAGGUGCCCAGCAAGAAGUUCAAGGUGCUGGGCAACACCGACCGGCACAGCAUCAAGAAGAACCUGAUCGGCGCCCUGC
UGUUCGACAGCGGCGAGACCGCCGAGGCCACCCGGCUGAAGCGGACCGCCCGGCGGCGGUACACCCGGCGGAAGAACCGGAUC
UGCUACCUGCAGGAGAUCUUCAGCAACGAGAUGGCCAAGGUGGACGACAGCUUCUUCCACCGGCUGGAGGAGAGCUUCCUGGU
GGAGGAGGACAAGAAGCACGAGCGGCACCCCAUCUUCGGCAACAUCGUGGACGAGGUGGCCUACCACGAGAAGUACCCCACCA
UCUACCACCUGCGGAAGAAGCUGGUGGACAGCACCGACAAGGCCGACCUGCGGCUGAUCUACCUGGCCCUGGCCCACAUGAUC
AAGUUCCGGGGCCACUUCCUGAUCGAGGGCGACCUGAACCCCGACAACAGCGACGUGGACAAGCUGUUCAUCCAGCUGGUGCA
GACCUACAACCAGCUGUUCGAGGAGAACCCCAUCAACGCCAGCGGCGUGGACGCCAAGGCCAUCCUGAGCGCCCGGCUGAGCA
AGAGCCGGCGGCUGGAGAACCUGAUCGCCCAGCUGCCCGGCGAGAAGAAGAACGGCCUGUUCGGCAACCUGAUCGCCCUGAGC
CUGGGCCUGACCCCCAACUUCAAGAGCAACUUCGACCUGGCCGAGGACGCCAAGCUGCAGCUGAGCAAGGACACCUACGACGA
CGACCUGGACAACCUGCUGGCCCAGAUCGGCGACCAGUACGCCGACCUGUUCCUGGCCGCCAAGAACCUGAGCGACGCCAUCC
UGCUGAGCGACAUCCUGCGGGUGAACACCGAGAUCACCAAGGCCCCCCUGAGCGCCAGCAUGAUCAAGCGGUACGACGAGCAC
CACCAGGACCUGACCCUGCUGAAGGCCCUGGUGCGGCAGCAGCUGCCCGAGAAGUACAAGGAGAUCUUCUUCGACCAGAGCAA

-continued

GAACGGCUACGCCGGCUACAUCGACGGCGGCGCCAGCCAGGAGGAGUUCUACAAGUUCAUCAAGCCCAUCCUGGAGAAGAUGG

ACGGCACCGAGGAGCUGCUGGUGAAGCUGAACCGGGAGGACCUGCUGCGGAAGCAGCGGACCUUCGACAACGGCAGCAUCCCC

CACCAGAUCCACCUGGGCGAGCUGCACGCCAUCCUGCGGCGGCAGGAGGACUUCUACCCCUUCCUGAAGGACAACGGGAGAA

GAUCGAGAAGAUCCUGACCUUCCGGAUCCCCUACUACGUGGGCCCCCUGGCCCGGGGCAACAGCCGGUUCGCCUGGAUGACCC

GGAAAUCCGAGGAGACCAUCACCCCCUGGAACUUCGAGGAGGUGGUGGACAAGGGCGCCAGCGCCCAGAGCUUCAUCGAGCGG

AUGACCAACUUCGACAAGAACCUGCCCAACGAGAAGGUGCUGCCCAAGCACAGCCUGCUGUACGAGUACUUCACCGUGUACAA

CGAGCUGACCAAGGUGAAGUACGUGACCGAGGGCAUGCGGAAGCCCGCCUUCCUGAGCGGCGAGCAGAAGAAGGCCAUCGUGG

ACCUGCUGUUCAAGACCAACCGGAAGGUGACCGUGAAGCAGCUGAAGGAGGACUACUUCAAGAAGAUCGAGUGCUUCGACAGC

GUGGAGAUCAGCGGCGUGGAGGACCGGUUCAACGCCAGCCUGGGCACCUACCACGACCUGCUGAAGAUCAUCAAGGACAAGGA

CUUCCUGGACAACGAGGAGAACGAGGACAUCCUGGAGGACAUCGUGCUGACCCUGACCCUGUUCGAGGACCGGGAGAUGAUCG

AGGAGCGGCUGAAAACCUACGCCCACCUGUUCGACGACAAGGUGAUGAAGCAGCUGAAGCGGCGGCGGUACACCGGCUGGGGC

CGGCUGAGCCGGAAGCUGAUCAACGGCAUCCGGGACAAGCAGAGCGGCAAGACCAUCCUGGACUUCCUGAAAUCCGACGGCUU

CGCCAACCGGAACUUCAUGCAGCUGAUCCACGACGACAGCCUGACCUUCAAGGAGGACAUCCAGAAGGCCCAGGUGAGCGGCC

AGGGCGACAGCCUGCACGAGCACAUCGCCAACCUGGCCGGCAGCCCCGCCAUCAAGAAGGGCAUCCUGCAGACCGUGAAGGUG

GUGGACGAGCUGGUGAAGGUGAUGGGCCGGCACAAGCCCGAGAACAUCGUGAUCGAGAUGGCCCGGGAGAACCAGACCACCCA

GAAGGGCCAGAAGAACAGCCGGGAGCGGAUGAAGCGGAUCGAGGAGGGCAUCAAGGAGCUGGGCAGCCAGAUCCUGAAGGAGC

ACCCCGUGGAGAACACCCAGCUGCAGAACGAGAAGCUGUACCUGUACUACCUGCAGAACGGCCGGGACAUGUACGUGGACCAG

GAGCUGGACAUCAACCGGCUGAGCGACUACGACGUGGCCGCCAUCGUGCCCCAGAGCUUCCUGAAGGACGACAGCAUCGACAA

CAAGGUGCUGACCCGGAGCGACAAGGCCCGGGGCAAGAGCGACAACGUGCCCAGCGAGGAGGUGGUGAAGAAGAUGAAGAACU

ACUGGCGGCAGCUGCUGAACGCCAAGCUGAUCACCCAGCGGAAGUUCGACAACCUGACCAAGGCCGAGCGGGGCGGCCUGAGC

GAGCUGGACAAGGCCGGCUUCAUCAAGCGGCAGCUGGUGGAGACCCGGCAGAUCACCAAGCACGUGGCCCAGAUCCUGGACAG

CCGGAUGAACACCAAGUACGACGAGAACGACAAGCUGAUCCGGGAGGUGAAGGUGAUCACCCUGAAAUCCAAGCUGGUGAGCG

ACUUCCGGAAGGACUUCCAGUUCUACAAGGUGCGGGAGAUCAACAACUACCACCACGCCCACGACGCCUACCUGAACGCCGUG

GUGGGCACCGCCCUGAUCAAGAAGUACCCCAAGCUGGAGAGCGAGUUCGUGUACGGCGACUACAAGGUGUACGACGUGCGGAA

GAUGAUCGCCAAGAGCGAGCAGGAGAUCGGCAAGGCCACCGCCAAGUACUUCUUCUACAGCAACAUCAUGAACUUCUUCAAGA

CCGAGAUCACCCUGGCCAACGGCGAGAUCCGGAAGCGGCCCCUGAUCGAGACCAACGGCGAGACCGGCGAGAUCGUGUGGGAC

AAGGGCCGGGACUUCGCCACCGUGCGGAAGGUGCUGAGCAUGCCCCAGGUGAACAUCGUGAAGAAAACCGAGGUGCAGACCGG

CGGCUUCAGCAAGGAGAGCAUCCUGCCCAAGCGGAACAGCGACAAGCUGAUCGCCCGGAAGAAGGACUGGGACCCCAAGAAGU

ACGGCGGCUUCGACAGCCCCACCGUGGCCUACAGCGUGCUGGUGGUGGCCAAGGUGGAGAAGGGCAAGAGCAAGAAGCUGAAA

UCCGUGAAGGAGCUGCUGGGCAUCACCAUCAUGGAGCGGAGCAGCUUCGAGAAGAACCCCAUCGACUUCCUGGAGGCCAAGGG

CUACAAGGAGGUGAAGAAGGACCUGAUCAUCAAGCUGCCCAAGUACAGCCUGUUCGAGCUGGAGAACGGCCGGAAGCGGAUGC

UGGCCAGCGCCGGCGAGCUGCAGAAGGGCAACGAGCUGGCCCUGCCCAGCAAGUACGUGAACUUCCUGUACCUGGCCAGCCAC

UACGAGAAGCUGAAGGGCAGCCCCGAGGACAACGAGCAGAAGCAGCUGUUCGUGGAGCAGCACAAGCACUACCUGGACGAGAU

CAUCGAGCAGAUCAGCGAGUUCAGCAAGCGGGUGAUCCUGGCCGACGCCAACCUGGACAAGGUGCUGAGCGCCUACAACAAGC

ACCGGGACAAGCCCAUCCGGGAGCAGGCCGAGAACAUCAUCCACCUGUUCACCCUGACCAACCUGGGCGCCCCCGCCGCCUUC

AAGUACUUCGACACCACCAUCGACCGGAAGCGGUACACCAGCACCAAGGAGGUGCUGGACGCCACCCUGAUCCACCAGAGCAU

CACCGGCCUGUACGAGACCCGGAUCGACCUGAGCCAGCUGGGCGGCGACAAGCGGCCCGCCGCCACCAAGAAGGCCGGCCAGG

CCAAGAAGAAGAAGGGCCGGGCCGACGCCCUGGACGACUUCGACCUGGACAUGCUGGGCAGCGACGCCCUGGACGACUUCGAC

CUGGACAUGCUGGGCAGCGACGCCCUGGACGACUUCGACCUGGACAUGCUGGGCAGCGACGCCCUGGACGACUUCGACCUGGA

CAUGCUGAGCGGCGGCCCCAAGAAGAAGCGGAAGGUGGGCAGCCAGUACCUGCCCGACACCGACGACCGGCACCGGAUCGAGG

AGAAGCGGAAGCGGACCUACGAGACCUUCAAGAGCAUCAUGAAGAAAUCCCCCUUCAGCGGCCCCACCGACCCCCGGCCCCCC

-continued

```
CCCCGGCGGAUCGCCGUGCCCAGCCGGAGCAGCGCCAGCGUGCCCAAGCCCGCCCCCAGCCCUACCCCUUCACCAGCAGCCU
GAGCACCAUCAACUACGACGAGUUCCCCACCAUGGUGUUCCCCAGCGGCCAGAUCAGCCAGGCCAGCGCCCUGGCCCCCGCCC
CCCCCAGGUGCUGCCCCAGGCCCCCGCCCCCGCCCCCGCCCCCGCCAUGGUGAGCGCCCUGGCCCAGGCCCCCGCCCCCGUG
CCCGUGCUGGCCCCCGGCCCCCCCCAGGCCGUGGCCCCCCCCGCCCCCAAGCCCACCCAGGCCGGCGAGGGCACCCUGAGCGA
GGCCCUGCUGCAGCUGCAGUUCGACGACGAGGACCUGGGCGCCCUGCUGGGCAACAGCACCGACCCCGCCGUGUUCACCGACC
UGGCCAGCGUGGACAACAGCGAGUUCCAGCAGCUGCUGAACCAGGGCAUCCCCGUGGCCCCCCACACCACCGAGCCCAUGCUG
AUGGAGUACCCCGAGGCCAUCACCCGGCUGGUGACCGGCGCCCAGCGGCCCCCCGACCCCGCCCCCGCCCCCUGGGCGCCCC
CGGCCUGCCCAACGGCCUGCUGAGCGGCGACGAGGACUUCAGCAGCAUCGCCGACAUGGACUUCAGCGCCCUGCUGGGCAGCG
GCAGCGGCAGCCGGGACAGCCGGGAGGGCAUGUUCCUGCCCAAGCCCGAGGCCGGCAGCGCCAUCAGCGACGUGUUCGAGGGC
CGGGAGGUGUGCCAGCCCAAGCGGAUCCGGCCCUUCCACCCCCCCGGCAGCCCCUGGGCCAACCGGCCCCUGCCCGCCAGCCU
GGCCCCCACCCCCACCGGCCCCGUGCACGAGCCCGUGGGCAGCCUGACCCCCGCCCCCGUGCCCAGCCCCUGGACCCCGCCC
CCGCCGUGACCCCCGAGGCCAGCCACCUGCUGGAGGACCCCGACGAGGAGACCAGCCAGGCCGUGAAGGCCCUGCGGGAGAUG
GCCGACACCGUGAUCCCCCAGAAGGAGGAGGCCGCCAUCUGCGGCCAGAUGGACCUGAGCCACCCCCCCCCCGGGGCCACCU
GGACGAGCUGACCACCACCCUGGAGAGCAUGACCGAGGACCUGAACCUGGACAGCCCCCUGACCCCCGAGCUGAACGAGAUCC
UGGACACCUUCCUGAACGACGAGUGCCUGCUGCACGCCAUGCACAUCAGCACCGGCCUGAGCAUCUUCGACACCAGCCUGUUC
AGCGGCGGCAAGCGGCCCGCCGCCACCAAGAAGGCCGGCCAGGCCAAGAAGAAGAAGGGCAGCUACCCCUACGACGUGCCCGA
CUACGCCUGAGCGGCCGCUUAAUUAAGCUGCCUUCUGCGGGGCUUGCCUUCUGGCCAUGCCCUUCUUCUCUCCCUUGCACCUG
UACCUCUUGGUCUUUGAAUAAAGCCUGAGUAGGAAGUCUAGAAAAAAAAAAAAAAAAAAAAAAAAAAAAAAAAAAAAAAAAAA
AAAAAAAAAAAAAAAAAAAAAAAAAAAAAAAAAAA
```

>dCas9 amino acid sequence

SEQ ID NO.: 97

DKKYSIGLAIGTNSVGWAVITDEYKVPSKKFKVLGNTDRHSIKKNLIGALLFDSGETAEATRLKRTARRRYTRRKNRICYLQE
IFSNEMAKVDDSFFHRLEESFLVEEDKKHERHPIFGNIVDEVAYHEKYPTIYHLRKKLVDSTDKADLRLIYLALAHMIKFRGH
FLIEGDLNPDNSDVDKLFIQLVQTYNQLFEENPINASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAILLSDILRVNTEITKAPLSASMIKRYDEHHQDLT
LLKALVRQQLPEKYKEIFFDQSKNGYAGYIDGGASQEEFYKFIKPILEKMDGTEELLVKLNREDLLRKQRTFDNGSIPHQIHL
GELHAILRRQEDFYPFLKDNREKIEKILTFRIPYYVGPLARGNSRFAWMTRKSEETITPWNFEEVVDKGASAQSFIERMTNFD
KNLPNEKVLPKHSLLYEYFTVYNELTKVKYVTEGMRKPAFLSGEQKKAIVDLLFKTNRKVTVKQLKEDYFKKIECFDSVEISG
VEDRFNASLGTYHDLLKIIKDKDFLDNEENEDILEDIVLTLTLFEDREMIEERLKTYAHLFDDKVMKQLKRRRYTGWGRLSRK
LINGIRDKQSGKTILDFLKSDGFANRNFMQLIHDDSLTFKEDIQKAQVSGQGDSLHEHIANLAGSPAIKKGILQTVKVVDELV
KVMGRHKPENIVIEMARENQTTQKGQKNSRERMKRIEEGIKELGSQILKEHPVENTQLQNEKLYLYYLQNGRDMYVDQELDIN
RLSDYDVAAIVPQSFLKDDSIDNKVLTRSDKARGKSDNVPSEEVVKKMKNYWRQLLNAKLITQRKFDNLTKAERGGLSELDKA
GFIKRQLVETRQITKHVAQILDSRMNTKYDENDKLIREVKVITLKSKLVSDFRKDFQFYKVREINNYHHAHDAYLNAVVGTAL
IKKYPKLESEFVYGDYKVYDVRKMIAKSEQEIGKATAKYFFYSNIMNFFKTEITLANGEIRKRPLIETNGETGEIVWDKGRDF
ATVRKVLSMPQVNIVKKTEVQTGGFSKESILPKRNSDKLIARKKDWDPKKYGGFDSPTVAYSVLVVAKVEKGKSKKLKSVKEL
LGITIMERSSFEKNPIDFLEAKGYKEVKKDLIIKLPKYSLFELENGRKRMLASAGELQKGNELALPSKYVNFLYLASHYEKLK
GSPEDNEQKQLFVEQHKHYLDEIIEQISEFSKRVILADANLDKVLSAYNKHRDKPIREQAENIIHLFTLTNLGAPAAFKYFDT
TIDRKRYTSTKEVLDATLIHQSITGLYETRIDLSQLGGD

>dCas9 mRNA sequence

SEQ ID NO.: 300

```
GACAAGAAGUACAGCAUCGGCCUGGCCAUCGGCACCAACAGCGUGGGCUGGGCCGUGAUCACCGACGAGUACAAGGUGCCCAG
CAAGAAGUUCAAGGUGCUGGGCAACACCGACCGGCACAGCAUCAAGAAGAACCUGAUCGGCGCCCUGCUGUUCGACAGCGGCG
```

-continued

```
AGACCGCCGAGGCCACCCGGCUGAAGCGGACCGCCCGGCGGCGGUACACCCGGCGGAAGAACCGGAUCUGCUACCUGCAGGAG
AUCUUCAGCAACGAGAUGGCCAAGGUGGACGACAGCUUCUUCCACCGGCUGGAGGAGAGCUUCCUGGUGGAGGAGGACAAGAA
GCACGAGCGGCACCCCAUCUUCGGCAACAUCGUGGACGAGGUGGCCUACCACGAGAAGUACCCCACCAUCUACCACCUGCGGA
AGAAGCUGGUGGACAGCACCGACAAGGCCGACCUGCGGCUGAUCUACCUGGCCCUGGCCCACAUGAUCAAGUUCCGGGGCCAC
UUCCUGAUCGAGGGCGACCUGAACCCCGACAACAGCGACGUGGACAAGCUGUUCAUCCAGCUGGUGCAGACCUACAACCAGCU
GUUCGAGGAGAACCCCAUCAACGCCAGCGGCGUGGACGCCAAGGCCAUCCUGAGCGCCCGGCUGAGCAAGAGCCGGCGGCUGG
AGAACCUGAUCGCCCAGCUGCCCGGCGAGAAGAAGAACGGCCUGUUCGGCAACCUGAUCGCCCUGAGCCUGGGCCUGACCCCC
AACUUCAAGAGCAACUUCGACCUGGCCGAGGACGCCAAGCUGCAGCUGAGCAAGGACACCUACGACGACGACCUGGACAACCU
GCUGGCCCAGAUCGGCGACCAGUACGCCGACCUGUUCCUGGCCGCCAAGAACCUGAGCGACGCCAUCCUGCUGAGCGACAUCC
UGCGGGUGAACACCGAGAUCACCAAGGCCCCCCUGAGCGCCAGCAUGAUCAAGCGGUACGACGAGCACCACCAGGACCUGACC
CUGCUGAAGGCCCUGGUGCGGCAGCAGCUGCCCGAGAAGUACAAGGAGAUCUUCUUCGACCAGAGCAAGAACGGCUACGCCGG
CUACAUCGACGGCGGCGCCAGCCAGGAGGAGUUCUACAAGUUCAUCAAGCCCAUCCUGGAGAAGAUGGACGGCACCGAGGAGC
UGCUGGUGAAGCUGAACCGGGAGGACCUGCUGCGGAAGCAGCGGACCUUCGACAACGGCAGCAUCCCCCACCAGAUCCACCUG
GGCGAGCUGCACGCCAUCCUGCGGCGGCAGGAGGACUUCUACCCCUUCCUGAAGGACAACCGGGAGAAGAUCGAGAAGAUCCU
GACCUUCCGGAUCCCCUACUACGUGGGCCCCCUGGCCCGGGGCAACAGCCGGUUCGCCUGGAUGACCCGGAAAUCCGAGGAGA
CCAUCACCCCCUGGAACUUCGAGGAGGUGGUGGACAAGGGCGCCAGCGCCCAGAGCUUCAUCGAGCGGAUGACCAACUUCGAC
AAGAACCUGCCCAACGAGAAGGUGCUGCCCAAGCACAGCCUGCUGUACGAGUACUUCACCGUGUACAACGAGCUGACCAAGGU
GAAGUACGUGACCGAGGGCAUGCGGAAGCCCGCCUUCCUGAGCGGCGAGCAGAAGAAGGCCAUCGUGGACCUGCUGUUCAAGA
CCAACCGGAAGGUGACCGUGAAGCAGCUGAAGGAGGACUACUUCAAGAAGAUCGAGUGCUUCGACAGCGUGGAGAUCAGCGGC
GUGGAGGACCGGUUCAACGCCAGCCUGGGCACCUACCACGACCUGCUGAAGAUCAUCAAGGACAAGGACUUCCUGGACAACGA
GGAGAACGAGGACAUCCUGGAGGACAUCGUGCUGACCCUGACCCUGUUCGAGGACCGGGAGAUGAUCGAGGAGCGGCUGAAAA
CCUACGCCCACCUGUUCGACGACAAGGUGAUGAAGCAGCUGAAGCGGCGGCGGUACACCGGCUGGGGCCGGCUGAGCCGGAAG
CUGAUCAACGGCAUCCGGGACAAGCAGAGCGGCAAGACCAUCCUGGACUUCCUGAAAUCCGACGGCUUCGCCAACCGGAACUU
CAUGCAGCUGAUCCACGACGACAGCCUGACCUUCAAGGAGGACAUCCAGAAGGCCCAGGUGAGCGGCCAGGGCGACAGCCUGC
ACGAGCACAUCGCCAACCUGGCCGGCAGCCCCGCCAUCAAGAAGGGCAUCCUGCAGACCGUGAAGGUGGUGGACGAGCUGGUG
AAGGUGAUGGGCCGGCACAAGCCCGAGAACAUCGUGAUCGAGAUGGCCCGGGAGAACCAGACCACCCAGAAGGGCCAGAAGAA
CAGCCGGGAGCGGAUGAAGCGGAUCGAGGAGGGCAUCAAGGAGCUGGGCAGCCAGAUCCUGAAGGAGCACCCCGUGGAGAACA
CCCAGCUGCAGAACGAGAAGCUGUACCUGUACUACCUGCAGAACGGCCGGGACAUGUACGUGGACCAGGAGCUGGACAUCAAC
CGGCUGAGCGACUACGACGUGGCCGCCAUCGUGCCCCAGAGCUUCCUGAAGGACGACAGCAUCGACAACAAGGUGCUGACCCG
GAGCGACAAGGCCCGGGGCAAGAGCGACAACGUGCCCAGCGAGGAGGUGGUGAAGAAGAUGAAGAACUACUGGCGGCAGCUGC
UGAACGCCAAGCUGAUCACCCAGCGGAAGUUCGACAACCUGACCAAGGCCGAGCGGGGCGGCCUGAGCGAGCUGGACAAGGCC
GGCUUCAUCAAGCGGCAGCUGGUGGAGACCCGGCAGAUCACCAAGCACGUGGCCCAGAUCCUGGACAGCCGGAUGAACACCAA
GUACGACGAGAACGACAAGCUGAUCCGGGAGGUGAAGGUGAUCACCCUGAAAUCCAAGCUGGUGAGCGACUUCCGGAAGGACU
UCCAGUUCUACAAGGUGCGGGAGAUCAACAACUACCACCACGCCCACGACGCCUACCUGAACGCCGUGGUGGGCACCGCCCUG
AUCAAGAAGUACCCCAAGCUGGAGAGCGAGUUCGUGUACGGCGACUACAAGGUGUACGACGUGCGGAAGAUGAUCGCCAAGAG
CGAGCAGGAGAUCGGCAAGGCCACCGCCAAGUACUUCUUCUACAGCAACAUCAUGAACUUCUUCAAGACCGAGAUCACCCUGG
CCAACGGCGAGAUCCGGAAGCGGCCCCUGAUCGAGACCAACGGCGAGACCGGCGAGAUCGUGUGGGACAAGGGCCGGGACUUC
GCCACCGUGCGGAAGGUGCUGAGCAUGCCCCAGGUGAACAUCGUGAAGAAAACCGAGGUGCAGACCGGCGGCUUCAGCAAGGA
GAGCAUCCUGCCCAAGCGGAACAGCGACAAGCUGAUCGCCCGGAAGAAGGACUGGGACCCCAAGAAGUACGGCGGCUUCGACA
GCCCCACCGUGGCCUACAGCGUGCUGGUGGUGGCCAAGGUGGAGAAGGGCAAGAGCAAGAAGCUGAAAUCCGUGAAGGAGCUG
CUGGGCAUCACCAUCAUGGAGCGGAGCAGCUUCGAGAAGAACCCCAUCGACUUCCUGGAGGCCAAGGGCUACAAGGAGGUGAA
```

-continued

```
GAAGGACCUGAUCAUCAAGCUGCCCAAGUACAGCCUGUUCGAGCUGGAGAACGGCCGGAAGCGGAUGCUGGCCAGCGCCGGCG
AGCUGCAGAAGGGCAACGAGCUGGCCCUGCCCAGCAAGUACGUGAACUUCCUGUACCUGGCCAGCCACUACGAGAAGCUGAAG
GGCAGCCCCGAGGACAACGAGCAGAAGCAGCUGUUCGUGGAGCAGCACAAGCACUACCUGGACGAGAUCAUCGAGCAGAUCAG
CGAGUUCAGCAAGCGGGUGAUCCUGGCCGACGCCAACCUGGACAAGGUGCUGAGCGCCUACAACAAGCACCGGGACAAGCCCA
UCCGGGAGCAGGCCGAGAACAUCAUCCACCUGUUCACCCUGACCAACCUGGGCGCCCCCGCCGCCUUCAAGUACUUCGACACC
ACCAUCGACCGGAAGCGGUACACCAGCACCAAGGAGGUGCUGGACGCCACCCUGAUCCACCAGAGCAUCACCGGCCUGUACGA
GACCCGGAUCGACCUGAGCCAGCUGGGCGGCGAC
```

>dCas9-P300 protein

SEQ ID NO.: 98

```
MAPKKKRKVGIHGVPAADKKYSIGLAIGTNSVGWAVITDEYKVPSKKFKVLGNTDRHSIKKNLIGALLFDSGETAEATRLKRT
ARRRYTRRKNRICYLQEIFSNEMAKVDDSFFHRLEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENPINASGVDAKAILSARLSKSRRLENLIAQLPGEK
KNGLFGNLIALSLGLTPNFKSNFDLAEDAKLQLSKDTYDDDLDNLLAQIGDQYADLFLAAKNLSDAILLSDILRVNTEITKAP
LSASMIKRYDEHHQDLTLLKALVRQQLPEKYKEIFFDQSKNGYAGYIDGGASQEEFYKFIKPILEKMDGTEELLVKLNREDLL
RKQRTEDNGSIPHQIHLGELHAILRRQEDFYPFLKDNREKIEKILTFRIPYYVGPLARGNSRFAWMTRKSEETITPWNFEEVV
DKGASAQSFIERMTNFDKNLPNEKVLPKHSLLYEYFTVYNELTKVKYVTEGMRKPAFLSGEQKKAIVDLLFKTNRKVTVKQLK
EDYFKKIECFDSVEISGVEDRFNASLGTYHDLLKIIKDKDFLDNEENEDILEDIVLTLTLFEDREMIEERLKTYAHLFDDKVM
KQLKRRRYTGWGRLSRKLINGIRDKQSGKTILDFLKSDGFANRNFMQLIHDDSLTFKEDIQKAQVSGQGDSLHEHIANLAGSP
AIKKGILQTVKVVDELVKVMGRHKPENIVIEMARENQTTQKGQKNSRERMKRIEEGIKELGSQILKEHPVENTQLQNEKLYLY
YLQNGRDMYVDQELDINRLSDYDVAAIVPQSFLKDDSIDNKVLTRSDKARGKSDNVPSEEVVKKMKNYWRQLLNAKLITQRKF
DNLTKAERGGLSELDKAGFIKRQLVETRQITKHVAQILDSRMNTKYDENDKLIREVKVITLKSKLVSDFRKDFQFYKVREINN
YHHAHDAYLNAVVGTALIKKYPKLESEFVYGDYKVYDVRKMIAKSEQEIGKATAKYFFYSNIMNFFKTEITLANGEIRKRPLI
ETNGETGEIVWDKGRDFATVRKVLSMPQVNIVKKTEVQTGGFSKESILPKRNSDKLIARKKDWDEKKYGGFDSPTVAYSVLVV
AKVEKGKSKKLKSVKELLGITIMERSSFEKNPIDFLEAKGYKEVKKDLIIKLPKYSLFELENGRKRMLASAGELQKGNELALP
SKYVNFLYLASHYEKLKGSPEDNEQKQLFVEQHKHYLDEIIEQISEFSKRVILADANLDKVLSAYNKHRDKPIREQAENIIHL
FTLTNLGAPAAFKYFDTTIDRKRYTSTKEVLDATLIHQSITGLYETRIDLSQLGGDKRPAATKKAGQAKKKKGRAIFKPEELR
QALMPTLEALYRQDPESLPFRQPVDPQLLGIPDYFDIVKSPMDLSTIKRKLDTGQYQEPWQYVDDIWLMFNNAWLYNRKTSRV
YKYCSKLSEVFEQEIDPVMQSLGYCCGRKLEFSPQTLCCYGKQLCTIPRDATYYSYQNRYHFCEKCFNEIQGESVSLGDDPSQ
PQTTINKEQFSKRKNDTLDPELFVECTECGRKMHQICVLHHEIIWPAGFVCDGCLKKSARTRKENKFSAKRLPSTRLGTFLEN
RVNDFLRRQNHPESGEVTVRVVHASDKTVEVKPGMKARFVDSGEMAESFPYRTKALFAFEEIDGVDLCFFGMHVQEYGSDCPP
PNQRRVYISYLDSVHFFREKCLRTAVYHEILIGYLEYVKKLGYTTGHIWACPPSEGDDYIFHCHPPDQKIPKPKRLQEWYKKM
LDKAVSERIVHDYKDIFKQATEDRLTSAKELPYFEGDFWPNVLEESIKELEQEEEERKREENTSNESTDVTKGDSKNAKKKNN
KKTSKNKSSLSRGNKKKPGMPNVSNDLSQKLYATMEKHKEVFFVIRLIAGPAANSLPPIVDPDPLIPCDLMDGRDAFLTLARD
KHLEFSSLRRAQWSTMCMLVELHTQSQDSGGKRPAATKKAGQAKKKKGSYPYDVPDYA*
```

>dCas9-p300 mRNA

SEQ ID NO.: 99

```
AGGAAAUAAGAGAGAAAAGAAGAGUAAGAAGAAAUAUAAGAGCCACCAUGGCCCCCAAGAAGAAGCGGAAGGUGGGCAUCCAC
GGCGUGCCCGCCGCCGACAAGAAGUACAGCAUCGGCCUGGCCAUCGGCACCAACAGCGUGGGCUGGGCCGUGAUCACCGACGA
GUACAAGGUGCCCAGCAAGAAGUUCAAGGUGCUGGGCAACACCGACCGGCACAGCAUCAAGAAGAACCUGAUCGGCGCCCUGC
UGUUCGACAGCGGCGAGACCGCCGAGGCCACCCGGCUGAAGCGGACCGCCCGGCGGCGGUACACCCGGCGGAAGAACCGGAUC
UGCUACCUGCAGGAGAUCUUCAGCAACGAGAUGGCCAAGGUGGACGACAGCUUCUUCCACCGGCUGGAGGAGAGCUUCCUGGU
GGAGGAGGACAAGAAGCACGAGCGGCACCCCAUCUUCGGCAACAUCGUGGACGAGGUGGCCUACCACGAGAAGUACCCCACCA
```

-continued

UCUACCACCUGCGGAAGAAGCUGGUGGACAGCACCGACAAGGCCGACCUGCGGCUGAUCUACCUGGCCCUGGCCCACAUGAUC
AAGUUCCGGGGCCACUUCCUGAUCGAGGGCGACCUGAACCCCGACAACAGCGACGUGGACAAGCUGUUCAUCCAGCUGGUGCA
GACCUACAACCAGCUGUUCGAGGAGAACCCCAUCAACGCCAGCGGCGUGGACGCCAAGGCCAUCCUGAGCGCCCGGCUGAGCA
AGAGCCGGCGGCUGGAGAACCUGAUCGCCCAGCUGCCCGGCGAGAAGAAGAACGGCCUGUUCGGCAACCUGAUCGCCCUGAGC
CUGGGCCUGACCCCCAACUUCAAGAGCAACUUCGACCUGGCCGAGGACGCCAAGCUGCAGCUGAGCAAGGACACCUACGACGA
CGACCUGGACAACCUGCUGGCCCAGAUCGGCGACCAGUACGCCGACCUGUUCCUGGCCGCCAAGAACCUGAGCGACGCCAUCC
UGCUGAGCGACAUCCUGCGGGUGAACACCGAGAUCACCAAGGCCCCCCUGAGCGCCAGCAUGAUCAAGCGGUACGACGAGCAC
CACCAGGACCUGACCCUGCUGAAGGCCCUGGUGCGGCAGCAGCUGCCCGAGAAGUACAAGGAGAUCUUCUUCGACCAGAGCAA
GAACGGCUACGCCGGCUACAUCGACGGCGGCGCCAGCCAGGAGGAGUUCUACAAGUUCAUCAAGCCCAUCCUGGAGAAGAUGG
ACGGCACCGAGGAGCUGCUGGUGAAGCUGAACCGGGAGGACCUGCUGCGGAAGCAGCGGACCUUCGACAACGGCAGCAUCCCC
CACCAGAUCCACCUGGGCGAGCUGCACGCCAUCCUGCGGCGGCAGGAGGACUUCUACCCCUUCCUGAAGGACAACCGGGAGAA
GAUCGAGAAGAUCCUGACCUUCCGGAUCCCCUACUACGUGGGCCCCCUGGCCCGGGGCAACAGCCGGUUCGCCUGGAUGACCC
GGAAAUCCGAGGAGACCAUCACCCCCUGGAACUUCGAGGAGGUGGUGGACAAGGGCGCCAGCGCCCAGAGCUUCAUCGAGCGG
AUGACCAACUUCGACAAGAACCUGCCCAACGAGAAGGUGCUGCCCAAGCACAGCCUGCUGUACGAGUACUUCACCGUGUACAA
CGAGCUGACCAAGGUGAAGUACGUGACCGAGGGCAUGCGGAAGCCCGCCUUCCUGAGCGGCGAGCAGAAGAAGGCCAUCGUGG
ACCUGCUGUUCAAGACCAACCGGAAGGUGACCGUGAAGCAGCUGAAGGAGGACUACUUCAAGAAGAUCGAGUGCUUCGACAGC
GUGGAGAUCAGCGGCGUGGAGGACCGGUUCAACGCCAGCCUGGGCACCUACCACGACCUGCUGAAGAUCAUCAAGGACAAGGA
CUUCCUGGACAACGAGGAGAACGAGGACAUCCUGGAGGACAUCGUGCUGACCCUGACCCUGUUCGAGGACCGGGAGAUGAUCG
AGGAGCGGCUGAAAACCUACGCCCACCUGUUCGACGACAAGGUGAUGAAGCAGCUGAAGCGGCGGCGGUACACCGGCUGGGGC
CGGCUGAGCCGGAAGCUGAUCAACGGCAUCCGGGACAAGCAGAGCGGCAAGACCAUCCUGGACUUCCUGAAAUCCGACGGCUU
CGCCAACCGGAACUUCAUGCAGCUGAUCCACGACGACAGCCUGACCUUCAAGGAGGACAUCCAGAAGGCCCAGGUGAGCGGCC
AGGGCGACAGCCUGCACGAGCACAUCGCCAACCUGGCCGGCAGCCCCGCCAUCAAGAAGGGCAUCCUGCAGACCGUGAAGGUG
GUGGACGAGCUGGUGAAGGUGAUGGGCCGGCACAAGCCCGAGAACAUCGUGAUCGAGAUGGCCCGGGAGAACCAGACCACCCA
GAAGGGCCAGAAGAACAGCCGGGAGCGGAUGAAGCGGAUCGAGGAGGGCAUCAAGGAGCUGGGCAGCCAGAUCCUGAAGGAGC
ACCCCGUGGAGAACACCCAGCUGCAGAACGAGAAGCUGUACCUGUACUACCUGCAGAACGGCCGGGACAUGUACGUGGACCAG
GAGCUGGACAUCAACCGGCUGAGCGACUACGACGUGGCCGCCAUCGUGCCCCAGAGCUUCCUGAAGGACGACAGCAUCGACAA
CAAGGUGCUGACCCGGAGCGACAAGGCCCGGGGCAAGAGCGACAACGUGCCCAGCGAGGAGGUGGUGAAGAAGAUGAAGAACU
ACUGGCGGCAGCUGCUGAACGCCAAGCUGAUCACCCAGCGGAAGUUCGACAACCUGACCAAGGCCGAGCGGGGCGGCCUGAGC
GAGCUGGACAAGGCCGGCUUCAUCAAGCGGCAGCUGGUGGAGACCCGGCAGAUCACCAAGCACGUGGCCCAGAUCCUGGACAG
CCGGAUGAACACCAAGUACGACGAGAACGACAAGCUGAUCCGGGAGGUGAAGGUGAUCACCCUGAAAUCCAAGCUGGUGAGCG
ACUUCCGGAAGGACUUCCAGUUCUACAAGGUGCGGGAGAUCAACAACUACCACCACGCCCACGACGCCUACCUGAACGCCGUG
GUGGGCACCGCCCUGAUCAAGAAGUACCCCAAGCUGGAGAGCGAGUUCGUGUACGGCGACUACAAGGUGUACGACGUGCGGAA
GAUGAUCGCCAAGAGCGAGCAGGAGAUCGGCAAGGCCACCGCCAAGUACUUCUUCUACAGCAACAUCAUGAACUUCUUCAAGA
CCGAGAUCACCCUGGCCAACGGCGAGAUCCGGAAGCGGCCCCUGAUCGAGACCAACGGCGAGACCGGCGAGAUCGUGUGGGAC
AAGGGCCGGGACUUCGCCACCGUGCGGAAGGUGCUGAGCAUGCCCCAGGUGAACAUCGUGAAGAAAACCGAGGUGCAGACCGG
CGGCUUCAGCAAGGAGAGCAUCCUGCCCAAGCGGAACAGCGACAAGCUGAUCGCCCGGAAGAAGGACUGGGACCCCAAGAAGU
ACGGCGGCUUCGACAGCCCCACCGUGGCCUACAGCGUGCUGGUGGUGGCCAAGGUGGAGAAGGGCAAGAGCAAGAAGCUGAAA
UCCGUGAAGGAGCUGCUGGGCAUCACCAUCAUGGAGCGGAGCAGCUUCGAGAAGAACCCCAUCGACUUCCUGGAGGCCAAGGG
CUACAAGGAGGUGAAGAAGGACCUGAUCAUCAAGCUGCCCAAGUACAGCCUGUUCGAGCUGGAGAACGGCCGGAAGCGGAUGC
UGGCCAGCGCCGGCGAGCUGCAGAAGGGCAACGAGCUGGCCCUGCCCAGCAAGUACGUGAACUUCCUGUACCUGGCCAGCCAC
UACGAGAAGCUGAAGGGCAGCCCCGAGGACAACGAGCAGAAGCAGCUGUUCGUGGAGCAGCACAAGCACUACCUGGACGAGAU

-continued

```
CAUCGAGCAGAUCAGCGAGUUCAGCAAGCGGGUGAUCCUGGCCGACGCCAACCUGGACAAGGUGCUGAGCGCCUACAACAAGC
ACCGGGACAAGCCCAUCCGGGAGCAGGCCGAGAACAUCAUCCACCUGUUCACCCUGACCAACCUGGGCGCCCCCGCCGCCUUC
AAGUACUUCGACACCACCAUCGACCGGAAGCGGUACACCAGCACCAAGGAGGUGCUGGACGCCACCCUGAUCCACCAGAGCAU
CACCGGCCUGUACGAGACCCGGAUCGACCUGAGCCAGCUGGGCGGCGACAAGCGGCCCGCCGCCACCAAGAAGGCCGGCCAGG
CCAAGAAGAAGAAGGGCCGGGCCAUCUUCAAGCCCGAGGAGCUGCGGCAGGCCCUGAUGCCCACCCUGGAGGCCCUGUACCGG
CAGGACCCCGAGAGCCUGCCCUUCCGGCAGCCCGUGGACCCCCAGCUGCUGGGCAUCCCCGACUACUUCGACAUCGUGAAAUC
CCCCAUGGACCUGAGCACCAUCAAGCGGAAGCUGGACACCGGCCAGUACCAGGAGCCCUGGCAGUACGUGGACGACAUCUGGC
UGAUGUUCAACAACGCCUGGCUGUACAACCGGAAAACCAGCCGGGUGUACAAGUACUGCAGCAAGCUGAGCGAGGUGUUCGAG
CAGGAGAUCGACCCCGUGAUGCAGAGCCUGGGCUACUGCUGCGGCCGGAAGCUGGAGUUCAGCCCCCAGACCCUGUGCUGCUA
CGGCAAGCAGCUGUGCACCAUCCCCCGGGACGCCACCUACUACAGCUACCAGAACCGGUACCACUUCUGCGAGAAGUGCUUCA
ACGAGAUCCAGGGCGAGAGCGUGAGCCUGGGCGACGACCCCAGCCAGCCCCAGACCACCAUCAACAAGGAGCAGUUCAGCAAG
CGGAAGAACGACACCCUGGACCCCGAGCUGUUCGUGGAGUGCACCGAGUGCGGCCGGAAGAUGCACCAGAUCUGCGUGCUGCA
CCACGAGAUCAUCUGGCCCGCCGGCUUCGUGUGCGACGGCUGCCUGAAGAAAUCCGCCCGGACCCGGAAGGAGAACAAGUUCA
GCGCCAAGCGGCUGCCCAGCACCCGGCUGGGCACCUUCCUGGAGAACCGGGUGAACGACUUCCUGGCGGCGGCAGAACCACCCC
GAGAGCGGCGAGGUGACCGUGCGGGUGGUGCACGCCAGCGACAAGACCGUGGAGGUGAAGCCCGGCAUGAAGGCCCGGUUCGU
GGACAGCGGCGAGAUGGCCGAGAGCUUCCCCUACCGGACCAAGGCCCUGUUCGCCUUCGAGGAGAUCGACGGCGUGGACCUGU
GCUUCUUCGGCAUGCACGUGCAGGAGUACGGCAGCGACUGCCCCCCCCCCAACCAGCGGCGGGUGUACAUCAGCUACCUGGAC
AGCGUGCACUUCUUCCGGCCCAAGUGCCUGCGGACCGCCGUGUACCACGAGAUCCUGAUCGGCUACCUGGAGUACGUGAAGAA
GCUGGGCUACACCACCGGCCACAUCUGGGCCUGCCCCCCCAGCGAGGGCGACGACUACAUCUUCCACUGCCACCCCCCCGACC
AGAAGAUCCCCAAGCCCAAGCGGCUGCAGGAGUGGUACAAGAAGAUGCUGGACAAGGCCGUGAGCGAGCGGAUCGUGCACGAC
UACAAGGACAUCUUCAAGCAGGCCACCGAGGACCGGCUGACCAGCGCCAAGGAGCUGCCCUACUUCGAGGGCGACUUCUGGCC
CAACGUGCUGGAGGAGAGCAUCAAGGAGCUGGAGCAGGAGGAGGAGGAGCGGAAGCGGGAGGAGAACACCAGCAACGAGAGCA
CCGACGUGACCAAGGGCGACAGCAAGAACGCCAAGAAGAAGAACAACAAGAAAACCAGCAAGAACAAGAGCAGCCUGAGCCGG
GGCAACAAGAAGAAGCCCGGCAUGCCCAACGUGAGCAACGACCUGAGCCAGAAGCUGUACGCCACCAUGGAGAAGCACAAGGA
GGUGUUCUUCGUGAUCCGGCUGAUCGCCGGCCCCGCCGCCAACAGCCUGCCCCCCAUCGUGGACCCCGACCCCCUGAUCCCCU
GCGACCUGAUGGACGGCCGGGACGCCUUCCUGACCCUGGCCCGGGACAAGCACCUGGAGUUCAGCAGCCUGCGGCGGGCCCAG
UGGAGCACCAUGUGCAUGCUGGUGGAGCUGCACACCCAGAGCCAGGACAGCGGCGGCAAGCGGCCCGCCGCCACCAAGAAGGC
CGGCCAGGCCAAGAAGAAGAAGGGCAGCUACCCCUACGACGUGCCCGACUACGCCCUGAGCGGCCGCUUAAUUAAGCUGCCUUC
UGCGGGGCUUGCCUUCGGCCAUGCCCUUCUUCUCUCCCUUGCACCUGUACCUCUUGGUCUUUGAAUAAAGCCUGAGUAGGAA
GUCUAGAAAAAAAAAAAAAAAAAAAAAAAAAAAAAAAAAAAAAAAAAAAAAAAAAAAAAAAAAAAAAAAAAAAAAAAAAAAA
AAA
```

>ZF1-VPR protein

SEQ ID NO.: 100

MAPKKKRKVGIHGVPAAGSSGSLEPGEKPYKCPECGKSFSRSDNLVRHQRTHTGEKPYKCPECGKSFSRSDHLTNHQRTHTGE
KPYKCPECGKSFSDPGHLVRHQRTHTGEKPYKCPECGKSFSQRAHLERHQRTHTGEKPYKCPECGKSFSSRRTCRAHQRTHTG
EKPYKCPECGKSFSRSDKLTEHQRTHTGEKPYKCPECGKSFSRNDTLTEHQRTHTGEKPTGKKTSASGSGGGSGGDALDDFDL
DMLGSDALDDFDLDMLGSDALDDFDLDMLGSDALDDFDLDMLSGGPKKKRKVGSQYLPDTDDRHRIEEKRKRTYETFKSIMKK
SPFSGPTDPRPPPRRIAVPSRSSASVPKPAPQPYPFTSSLSTINYDEFPTMVFPSGQISQASALAPAPPQVLPQAPAPAPAPA
MVSALAQAPAPVPVLAPGPPQAVAPPAPKPTQAGEGTLSEALLQLQFDDEDLGALLGNSTDPAVFTDLASVDNSEFQQLLNQG
IPVAPHTTEPMLMEYPEAITRLVTGAQRPPDPAPAPLGAPGLPNGLLSGDEDFSSIADMDFSALLGSGSGSRDSREGMFLPKP
EAGSAISDVFEGREVCQPKRLRPFHPPGSPWANRPLPASLAPTPTGPVHEPVGSLTPAPVPQPLDPAPAVTPEASHLLEDPDE

-continued

ETSQAVKALREMADTVIPQKEEAAICGQMDLSHPPPRGHLDELTTTLESMTEDLNLDSPLTPELNEILDTFLNDECLLHAMHI

STGLSIFDTSLFSGGKRPAATKKAGQAKKKKGSYPYDVPDYA*

ZF1-VPR mRNA

SEQ ID No.: 101

AGGAAAUAAGAGAGAAAAGAAGAGUAAGAAGAAAUAUAAGAGCCACCAUGGCCCCCAAGAAGAAGCGGAAGGUGGGCAUCCAC

GGCGUGCCCGCCGCCGGCAGCAGCGGAUCCCUGGAGCCGGGUGAGAAGCCAUACAAGUGCCCAGAAUGCGGCAAGAGCUUUAG

CCGCAGCGAUAAUCUGGUUCGUCAUCAGCGCACGCAUACGGGUGAGAAACCGUACAAAUGUCCAGAAUGCGGCAAAAGCUUUA

GUCGCAGCGAUCAUCUGACGAAUCACCAGCGCACCCAUACCGGCGAAAAACCGUACAAGUGCCCGGAGUGCGGUAAAAGCUUC

AGCGACCCGGGUCAUCUGGUGCGCCACCAACGCACGCACACCGGUGAGAAACCAUAUAAAUGUCCAGAGUGCGGCAAGAGUUU

UAGCCAGCGUGCCCAUCUGGAACGUCAUCAGCGUACCCACACGGGUGAAAAACCAUAUAAGUGCCCGGAGUGCGGUAAGAGUU

UUAGUAGCCGCCGUACGUGCCGUGCGCACCAACGCACCCACACCGGUGAAAAGCCAUACAAGUGUCCGGAAUGCGGCAAGAGC

UUCAGCCGCAGCGACAAACUCACCGAACAUCAACGUACCCAUACGGGCGAGAAGCCGUACAAAUGCCCAGAAUGUGGCAAAAG

CUUCAGUCGCAACGAUACGCUGACCGAGCAUCAGCGUACGCACACCGGCGAAAAGCCAACCGGCAAGAAAACCAGCGCUAGCG

GCAGCGGCGGCGGCAGCGGCGGCGACGCCCUGGACGACUUCGACCUGGACAUGCUGGGCAGCGACGCCCUGGACGACUUCGAC

CUGGACAUGCUGGGCAGCGACGCCCUGGACGACUUCGACCUGGACAUGCUGGGCAGCGACGCCCUGGACGACUUCGACCUGGA

CAUGCUGAGCGGCGGCCCCAAGAAGAAGCGGAAGGUGGGCAGCCAGUACCUGCCCGACACCGACGACCGGCACCGGAUCGAGG

AGAAGCGGAAGCGGACCUACGAGACCUUCAAGAGCAUCAUGAAGAAAUCCCCCUUCAGCGGCCCCACCGACCCCCGGCCCCCC

CCCCGGCGGAUCGCCGUGCCCAGCCGGAGCAGCGCCAGCGUGCCCAAGCCCGCCCCCCAGCCCUACCCCUUCACCAGCAGCCU

GAGCACCAUCAACUACGACGAGUUCCCCACCAUGGUGUUCCCCAGCGGCCAGAUCAGCCAGGCCAGCGCCCUGGCCCCCGCCC

CCCCCCAGGUGCUGCCCCAGGCCCCCGCCCCCGCCCCCGCCCCGCCAUGGUGAGCGCCCUGGCCCAGGCCCCCGCCCCCGUG

CCCGUGCUGGCCCCCGGCCCCCCCCAGGCCGUGGCCCCCCCGCCCCCAAGCCCACCCAGGCCGGCGAGGGCACCCUGAGCGA

GGCCCUGCUGCAGCUGCAGUUCGACGACGAGGACCUGGGCGCCCUGCUGGGCAACAGCACCGACCCCGCCGUGUUCACCGACC

UGGCCAGCGUGGACAACAGCGAGUUCCAGCAGCUGCUGAACCAGGGCAUCCCCGUGGCCCCCACACCACCGAGCCCAUGCUG

AUGGAGUACCCGAGGCCAUCACCCGGCUGGUGACCGGCGCCAGCGGCCCCCCGACCCCGCCCCGCCCCCUGGCGCCCC

CGGCCUGCCCAACGGCCUGCUGAGCGGCGACGAGGACUUCAGCAGCAUCGCCGACAUGGACUUCAGCGCCCUGCUGGGCAGCG

GCAGCGGCAGCCGGGACAGCCGGGAGGGCAUGUUCCUGCCCAAGCCCGAGGCCGGCAGCGCCAUCAGCGACGUGUUCGAGGGC

CGGGAGGUGUGCCAGCCCAAGCGGCUCCGGCCCUUCCACCCCCCCGGCAGCCCCUGGGCCAACCGGCCCCUGCCCGCCAGCCU

GGCCCCCACCCCCACCGGCCCCGUGCACGAGCCCGUGGGCAGCCUGACCCCGCCCCCGUGCCCAGCCCCUGGACCCCGCCC

CCGCCGUGACCCCCGAGGCCAGCCACCUGCUGGAGGACCCCGACGAGGAGACCAGCCAGGCCGUGAAGGCCCUGCGGGAGAUG

GCCGACACCGUGAUCCCCCAGAAGGAGGAGGCCGCCAUCUGCGGCCAGAUGGACUUGAGCCACCCCCCCCCCGGGGCCACCU

GGACGAGCUGACCACCACCCUGGAGAGCAUGACCGAGGACUGAACCUGGACAGCCCCUGACCCCCGAGCUGAACGAGAUCC

UGGACACCUUCCUGAACGACGAGUGCCUGCUGCACGCCAUGCACAUCAGCACCGGCCUGAGCAUCUUCGACACCAGCCUGUUC

AGCGGCGGCAAGCGGCCCGCCGCCACCAAGAAGGCCGGCCAGGCCAAGAAGAAGAAGGGCAGCUACCCCUACGACGUGCCCGA

CUACGCCUGAGCGGCCGCUUAAUUAAGCUGCCUUCUGCGGGGCUUGCCUUCUGGCCAUGCCCUUCUUCUCUCCCUUGCACCUG

UACCUCUUGGUCUUUGAAUAAAGCCUGAGUAGGAAGUCUAGAAAAAAAAAAAAAAAAAAAAAAAAAAAAAAAAAAAAAAAAAA

AAAAAAAAAAAAAAAAAAAAAAAAAAAAAAAAAA

>ZF1 target sequence

SEQ ID NO.: 102

CCGCGGCGUGGAGGCAGGGAG

>ZF1 amino acid sequence

SEQ ID NO.: 103

LEPGEKPYKCPECGKSFSRSDNLVRHQRTHTGEKPYKCPECGKSFSRSDHLTNHQRTHTGEKPYKCPECGKSFSDPGHLVRHQ

RTHTGEKPYKCPECGKSFSQRAHLERHQRTHTGEKPYKCPECGKSFSSRRTCRAHQRTHTGEKPYKCPECGKSFSRSDKLTEH

QRTHTGEKPYKCPECGKSFSRNDTLTEHQRTHTGEKPTGKKTS

-continued

>ZF1 mRNA sequence

SEQ ID NO.: 211

CUGGAGCCGGGUGAGAAGCCAUACAAGUGCCCAGAAUGCGGCAAGAGCUUUAGCCGCAGCGAUAAUCUGGUUCGUCAUCAGCG
CACGCAUACGGGUGAGAAACCGUACAAAUGUCCAGAAUGCGGCAAAAGCUUUAGUCGCAGCGAUCAUCUGACGAAUCACCAGC
GCACCCAUACCGGCGAAAAACCGUACAAGUGCCCGGAGUGCGGUAAAAGCUUCAGCGACCCGGGUCAUCUGGUGCGCCACCAA
CGCACGCACACCGGUGAGAAACCAUAUAAAUGUCCAGAGUGCGGCAAGAGUUUUAGCCAGCGUGCCCAUCUGGAACGUCAUCA
GCGUACCCACACGGGUGAAAAACCAUAUAAGUGCCCGGAGUGCGGUAAGAGUUUUAGUAGCCGCCGUACGUGCCGUGCGCACC
AACGCACCCACACCGGUGAAAAGCCAUACAAGUGUCCGGAAUGCGGCAAGAGCUUCAGCCGCAGCGACAAACUCACCGAACAU
CAACGUACCCAUACGGGCGAGAAGCCGUACAAAUGCCCAGAAUGUGGCAAAAGCUUCAGUCGCAACGAUACGCUGACCGAGCA
UCAGCGUACGCACACCGGCGAAAAGCCAACCGGCAAGAAAACCAGC

>ZF2-VPR protein

SEQ ID NO.: 104

MAPKKKRKVGIHGVPAAGSSGSLEPGEKPYKCPECGKSFSQSSNLVRHQRTHTGEKPYKCPECGKSFSSKKHLAEHQRTHTGE
KPYKCPECGKSFSSKKALTEHQRTHTGEKPYKCPECGKSFSDCRDLARHQRTHTGEKPYKCPECGKSFSDPGHLVRHQRTHTG
EKPYKCPECGKSFSRNDALTEHQRTHTGEKPYKCPECGKSFSDKKDLTRHQRTHTGEKPTGKKTSASGSGGGSGGDALDDFDL
DMLGSDALDDFDLDMLGSDALDDFDLDMLSGGPKKKRKVGSQYLPDTDDRHRIEEKRKRTYETFKSIMKK
SPFSGPTDPRPPPRRIAVPSRSSASVPKPAPQPYPFTSSLSTINYDEFPTMVFPSGQISQASALAPAPPQVLPQAPAPAPAPA
MVSALAQAPAPVPVLAPGPPQAVAPPAPKPTQAGEGTLSEALLQLQFDDEDLGALLGNSTDPAVFTDLASVDNSEFQQLLNQG
IPVAPHTTEPMLMEYPEAITRLVTGAQRPPDPAPAPLGAPGLPNGLLSGDEDFSSIADMDFSALLGSGSGSRDSREGMFLPKP
EAGSAISDVFEGREVCQPKRLRPFHPPGSPWANRPLPASLAPTPTGPVHEPVGSLTPAPVPQPLDPAPAVTPEASHLLEDPDE
ETSQAVKALREMADTVIPQKEEAAICGQMDLSHPPPRGHLDELTTTLESMTEDLNLDSPLTPELNEILDTFLNDECLLHAMHI
STGLSIFDTSLFSGGKRPAATKKAGQAKKKKGSYPYDVPDYA*

>ZF2-VPR mRNA

SEQ ID NO.: 105

AGGAAAUAAGAGAGAAAAGAAGAGUAAGAAGAAAUAUAAGAGCCACCAUGGCCCCCAAGAAGAAGCGGAAGGUGGGCAUCCAC
GGCGUGCCCGCCGCCGGCAGCAGCGGGAUCCCUGGAACCGGGCGAGAAACCGUACAAGUGCCCAGAAUGCGGUAAAAGCUUCAG
CCAGAGCAGUAAUCUGGUUCGUCACCAGCGCACCCACACGGGUGAAAAGCCAUACAAAUGUCCAGAGUGUGGUAAGAGUUUCA
GUAGCAAAAAGCAUCUGGCGGAACACCAACGUACGCAUACGGGUGAAAAGCCGUACAAGUGUCCGGAAUGUGGCAAGAGCUUU
AGCAGCAAGAAGGCGCUGACCGAACAUCAGCGUACCCAUACCGGUGAAAAACCAUACAAGUGCCCGGAGUGCGGCAAAAGUUU
CAGCGAUUGUCGCGAUCUGGCCCGUCAUCAACGCACCCACACCGGCGAGAAACCAUAUAAGUGUCCGGAGUGCGGUAAAAGCU
UUAGCGAUCCGGGCCAUCUGGUUCGCCACCAACGCACGCACACCGGCGAGAAACCGUAUAAGUGCCCAGAGUGCGGUAAGAGU
UUUAGCCGUAACGAUGCGCUGACGGAGCAUCAGCGCACGCACACGGGCGAGAAACCAUAUAAAUGCCCGGAAUGUGGUAAGAG
CUUCAGUGACAAAAAGGAUCUGACCCGCCAUCAACGUACGCAUACGGGCGAGAAGCCAACCGGCAAGAAAACCAGCGCUAGCG
GCAGCGGCGGCAGCGGCGGCGACGCCCUGGACGACUUCGACCUGGACAUGCUGGGCAGCGACGCCCUGGACGACUUCGACCUGGA
CAUGCUGGGCAGCGACGCCCUGGACGACUUCGACCUGGACAUGCUGGGCAGCGACGCCCUGGACGACUUCGACCUGGA
CAUGCUGAGCGGCGGCCCCAAGAAGAAGCGGAAGGUGGGCAGCCAGUACCUGCCCGACACCGACGACCGGCACCGGAUCGAGG
AGAAGCGGAAGCGGACCUACGAGACCUUCAAGAGCAUCAUGAAGAAAUCCCCCUUCAGCGGCCCCACCGACCCCCGGCCCCCC
CCCCGGCGGAUCGCCGUGCCCAGCCGGAGCAGCGCCAGCGUGCCCAAGCCCGCCCCCCAGCCCUACCCCUUCACCAGCAGCCU
GAGCACCAUCAACUACGACGAGUUCCCCACCAUGGUGUUCCCCAGCGGCCAGAUCAGCCAGGCCAGCGCCCUGGCCCCCGCCC
CCCCCCAGGUGCUGCCCCAGGCCCCCGCCCCCGCCCCCGCCCCCGCCAUGGUGAGCGCCCUGGCCCAGGCCCCCGCCCCCGUG
CCCGUGCUGGCCCCCGGCCCCCCCCAGGCCGUGGCCCCCCCCGCCCCCAAGCCCACCCAGGCCGGCGAGGGCACCCUGAGCGA
GGCCCUGCUGCAGCUGCAGUUCGACGACGAGGACCUGGGCGCCCUGCUGGGCAACAGCACCGACCCCGCCGUGUUCACCGACC
UGGCCAGCGUGGACAACAGCGAGUUCCAGCAGCUGCUGAACCAGGGCAUCCCCGUGGCCCCCCACACCACCGAGCCCAUGCUG

-continued

AUGGAGUACCCCGAGGCCAUCACCCGGCUGGUGACCGGCGCCCAGCGGCCCCCCGACCCCGCCCCCGCCCCCUGGGCGCCCC

CGGCCUGCCCAACGGCCUGCUGAGCGGCGACGAGGACUUCAGCAGCAUCGCCGACAUGGACUUCAGCGCCCUGCUGGGCAGCG

GCAGCGGCAGCCGGGACAGCCGGGAGGGCAUGUUCCUGCCCAAGCCCGAGGCCGGCAGCGCCAUCAGCGACGUGUUCGAGGGC

CGGGAGGUGUGCCAGCCCAAGCGGCUCCGGCCCUUCCACCCCCCCGGCAGCCCCUGGGCCAACCGGCCCCUGCCCGCCAGCCU

GGCCCCCACCCCCACCGGCCCCGUGCACGAGCCCGUGGGCAGCCUGACCCCCGCCCCCGUGCCCAGCCCCUGGACCCCGCCC

CCGCCGUGACCCCCGAGGCCAGCCACCUGCUGGAGGACCCCGACGAGGAGACCAGCCAGGCCGUGAAGGCCCUGCGGGAGAUG

GCCGACACCGUGAUCCCCCAGAAGGAGGAGGCCGCCAUCUGCGGCCAGAUGGACCUGAGCCACCCCCCCCCCGGGGCCACCU

GGACGAGCUGACCACCACCCUGGAGAGCAUGACCGAGGACCUGAACCUGGACAGCCCCCUGACCCCCGAGCUGAACGAGAUCC

UGGACACCUUCCUGAACGACGAGUGCCUGCUGCACGCCAUGCACAUCAGCACCGGCCUGAGCAUCUUCGACACCAGCCUGUUC

AGCGGCGGCAAGCGGCCCGCCGCCACCAAGAAGGCCGGCCAGGCCAAGAAGAAGAAGGGCAGCUACCCCUACGACGUGCCCGA

CUACGCCUGAGCGGCCGCUUAAUUAAGCUGCCUUCUGCGGGGCUUGCCUUCUGGCCAUGCCCUUCUUCUCUCCCUUGCACCUG

UACCUCUUGGUCUUUGAAUAAA

>ZF2 target sequence
SEQ ID NO.: 106
ACCCTGGGCGCCCACCCCGAA

>ZF2 amino acid sequence
SEQ ID NO.: 107
LEPGEKPYKCPECGKSFSQSSNLVRHQRTHTGEKPYKCPECGKSFSSKKHLAEHQRTHTGEKPYKCPECGKSFSSKKALTEHQ RTHTGEKPYKCPECGKSFSDCRDLARHQRTHTGEKPYKCPECGKSFSDPGHLVRHQRTHTGEKPYKCPECGKSFSRNDALTEH

QRTHTGEKPYKCPECGKSFSDKKDLTRHQRTHTGEKPTGKKTS

>ZF2 mRNA sequence
SEQ ID NO.: 212
CUGGAACCGGGCGAGAAACCGUACAAGUGCCCAGAAUGCGGUAAAAGCUUCAGCCAGAGCAGUAAUCUGGUUCGUCACCAGCG CACCCACACGGGUGAAAAGCCAUACAAAUGUCCAGAGUGUGGUAAGAGUUUCAGUAGCAAAAAGCAUCUGGCGGAACACCAAC GUACGCAUACGGGUGAAAAGCCGUACAAGUGUCCGGAAUGUGGCAAGAGCUUUAGCAGCAAGAAGGCGCUGACCGAACAUCAG CGUACCCAUACCGGUGAAAAACCAUACAAGUGCCCGGAGUGCGGCAAAAGUUUCAGCGAUUGUCGCGAUCUGGCCCGUCAUCA ACGCACCCACACCGGCGAGAAACCAUAUAAGUGUCCGGAGUGCGGUAAAAGCUUUAGCGAUCCGGGCCAUCUGGUUCGCCACC AACGCACGCACACCGGCGAGAAACCGUAUAAGUGCCCAGAGUGCGGUAAGAGUUUUAGCCGUAACGAUGCGCUGACGGAGCAU CAGCGCACGCACACGGGCGAGAAACCAUAUAAAUGCCCGGAAUGUGGUAAGAGCUUCAGUGACAAAAAGGAUCUGACCCGCCA

UCAACGUACGCAUACGGGCGAGAAGCCAACCGGCAAGAAAACCAGC

>ZF3-VPR protein
SEQ ID No.: 108
MAPKKKRKVGIHGVPAAGSSGSLEPGEKPYKCPECGKSFSRSDNLVRHQRTHTGEKPYKCPECGKSFSQLAHLRAHQRTHTGE KPYKCPECGKSFSDPGHLVRHQRTHTGEKPYKCPECGKSFSQSSNLVRHQRTHTGEKPYKCPECGKSFSRKDNLKNHQRTHTG EKPYKCPECGKSFSQAGHLASHQRTHTGEKPYKCPECGKSFSTSGSLVRHQRTHTGEKPTGKKTSASGSGGGSGGDALDDFDL

DMLGSDALDDFDLDMLGSDALDDFDLDMLGGPKKKRKVGSQYLPDTDDRHRIEEKRKRTYETFKSIMKK

SPFSGPTDPRPPPRRIAVPSRSSASVPKPAPQPYPFTSSLSTINYDEFPTMVFPSGQISQASALAPAPPQVLPQAPAPAPAPA

MVSALAQAPAPVPVLAPGPPQAVAPPAPKPTQAGEGTLSEALLQLQFDDEDLGALLGNSTDPAVFTDLASVDNSEFQQLLNQG

IPVAPHTTEPMLMEYPEAITRLVTGAQRPPDPAPAPLGAPGLPNGLLSGDEDFSSIADMDFSALLGSGSGSRDSREGMFLPKP

EAGSAISDVFEGREVCQPKRLRPFHPPGSPWANRPLPASLAPTPTGPVHEPVGSLTPAPVPQPLDPAPAVTPEASHLLEDPDE

ETSQAVKALREMADTVIPQKEEAAICGQMDLSHPPPRGHLDELTTTLESMTEDLNLDSPLTPELNEILDTFLNDECLLHAMHI

STGLSIFDTSLFSGGKRPAATKKAGQAKKKKGSYPYDVPDYA*

>ZF3-VPR mRNA
SEQ ID NO.: 109
AGGAAAUAAGAGAGAAAAGAAGAGUAAGAAGAAAUAUAAGAGCCACCAUGGCCCCCAAGAAGAAGCGGAAGGUGGGCAUCCAC

GGCGUGCCCGCCGCCGGCAGCAGCGGAUCCCUCGAACCGGGCGAGAAACCAUAUAAGUGUCCGGAAUGUGGUAAAAGUUUUAG

-continued

```
CCGCAGCGAUAAUCUCGUGCGUCACCAGCGUACGCAUACCGGUGAGAAGCCAUACAAGUGUCCGGAGUGUGGCAAAAGCUUCA

GUCAGCUGGCGCAUCUGCGCGCGCAUCAGCGCACCCACACCGGUGAGAAACCGUACAAGUGUCCAGAAUGCGGCAAAAGCUUU

AGCGAUCCGGGUCAUCUGGUGCGUCAUCAACGUACGCACACGGGCGAAAAACCGUACAAAUGUCCGGAGUGCGGCAAGAGCUU

CAGCCAGAGCAGCAAUCUGGUUCGCCACCAGCGUACGCACACCGGUGAAAAGCCAUACAAGUGCCCGGAGUGCGGCAAGAGUU

UCAGUCGCAAGGACAAUCUGAAGAACCAUCAACGCACCCAUACGGGCGAGAAGCCGUACAAAUGUCCGGAAUGCGGUAAAAGU

UUUAGCCAAGCCGGUCAUCUGGCCAGCCAUCAGCGUACCCAUACGGGUGAGAAACCGUAUAAAUGUCCAGAAUGUGGUAAGAG

UUUCAGCACCAGCGGUAGUCUGGUUCGUCAUCAACGCACGCAUACGGGUGAAAAACCAACCGGCAAGAAAACCAGCGCUAGCG

GCAGCGGCGGCGGCAGCGGCGGCGACGCCCUGGACGACUUCGACCUGGACAUGCUGGGCAGCGACGCCCUGGACGACUUCGAC

CUGGACAUGCUGGGCAGCGACGCCCUGGACGACUUCGACCUGGACAUGCUGGGCAGCGACGCCCUGGACGACUUCGACCUGGA

CAUGCUGAGCGGCGGCCCCAAGAAGAAGCGGAAGGUGGGCAGCCAGUACCUGCCCGACACCGACGACCGGCACCGGAUCGAGG

AGAAGCGGAAGCGGACCUACGAGACCUUCAAGAGCAUCAUGAAGAAAUCCCCCUUCAGCGGCCCCACCGACCCCCGGCCCCCC

CCCCGGCGGAUCGCCGUGCCCAGCCGGAGCAGCGCCAGCGUGCCCAAGCCCGCCCCCCAGCCCUACCCCUUCACCAGCAGCCU

GAGCACCAUCAACUACGACGAGUUCCCCACCAUGGUGUUCCCCAGCGGCCAGAUCAGCCAGGCCAGCGCCCUGGCCCCCGCCC

CCCCCAGGUGCUGCCCCAGGCCCCCGCCCCCGCCCCCGCCCCCGCCAUGGUGAGCGCCCUGGCCCAGGCCCCCGCCCCCGUG

CCCGUGCUGGCCCCCGGCCCCCCCCAGGCCGUGGCCCCCCCCGCCCCAAGCCCACCCAGGCCGGCGAGGGCACCCUGAGCGA

GGCCCUGCUGCAGCUGCAGUUCGACGACGAGGACCUGGGCGCCCUGCUGGGCAACAGCACCGACCCCGCCGUGUUCACCGACC

UGGCCAGCGUGGACAACAGCGAGUUCCAGCAGCUGCUGAACCAGGGCAUCCCCGUGGCCCCCACACCACCGAGCCCAUGCUG

AUGGAGUACCCCGAGGCCAUCACCCGGCUGGUGACCGGCGCCCAGCGGCCCCCCGACCCCGCCCCCGCCCCCCUGGGCGCCCC

CGGCCUGCCCAACGGCCUGCUGAGCGGCGACGAGGACUUCAGCAGCAUCGCCGACAUGGACUUCAGCGCCCUGCUGGGCAGCG

GCAGCGGCAGCCGGGACAGCCGGGAGGGCAUGUUCCUGCCCAAGCCCGAGGCCGGCAGCGCCAUCAGCGACGUGUUCGAGGGC

CGGGAGGUGUGCCAGCCCAAGCGGCUCCGGCCCUUCCACCCCCCCGGCAGCCCCUGGGCCAACCGGCCCCUGCCCGCCAGCCU

GGCCCCCACCCCCACCGGCCCCGUGCACGAGCCCGUGGGCAGCCUGACCCCCGCCCCCGUGCCCAGCCCCUGGACCCCGCCC

CCGCCGUGACCCCCGAGGCCAGCCACCUGCUGGAGGACCCCGACGAGGAGACCAGCCAGGCCGUGAAGGCCCUGCGGGAGAUG

GCCGACACCGUGAUCCCCCAGAAGGAGGAGGCCGCCAUCUGCGGCCAGAUGGACCUGAGCCACCCCCCCCCCGGGGCCACCU

GGACGAGCUGACCACCACCCUGGAGAGCAUGACCGAGGACCUGAACCUGGACAGCCCCCUGACCCCCGAGCUGAACGAGAUCC

UGGACACCUUCCUGAACGACGAGUGCCUGCUGCACGCCAUGCACAUCAGCACCGGCCUGAGCAUCUUCGACACCAGCCUGUUC

AGCGGCGGCAAGCGGCCCGCCGCCACCAAGAAGGCCGGCCAGGCCAAGAAGAAGAAGGGCAGCUACCCCUACGACGUGCCCGA

CUACGCCUGAGCGGCCGCUUAAUUAAGCUGCCUUCUGCGGGGCUUGCCUUCUGGCCAUGCCCUUCUUCUCUCCCUUGCACCUG

UACCUCUUGGUCUUUGAAUAAAGCCUGAGUAGGAAGUCUAGAAAAAAAAAAAAAAAAAAAAAAAAAAAAAAAAAAAAAAAAAA

AAAAAAAAAAAAAAAAAAAAAAAAAAAAAAAAA
```

>ZF3 target sequence

SEQ ID No.: 110

GTTTGAAAGGAAGGCAGAGAG

>ZF3 amino acid sequence

SEQ ID NO.: 111

LEPGEKPYKCPECGKSFSRSDNLVRHQRTHTGEKPYKCPECGKSFSQLAHLRAHQRTHTGEKPYKCPECGKSFSDPGHLVRHQ

RTHTGEKPYKCPECGKSFSQSSNLVRHQRTHTGEKPYKCPECGKSFSRKDNLKNHQRTHTGEKPYKCPECGKSFSQAGHLASH

QRTHTGEKPYKCPECGKSFSTSGSLVRHQRTHTGEKPTGKKTS

>ZF3 mRNA

SEQ ID NO.: 213

CUCGAACCGGGCGAGAAACCAUAUAAGUGUCCGGAAUGUGGUAAAAGUUUUAGCCGCAGCGAUAAUCUCGUGCGUCACCAGCG

UACGCAUACCGGUGAGAAGCCAUACAAGUGUCCGGAGUGUGGCAAAAGCUUCAGUCAGCUGGCGCAUCUGCGCGCGCAUCAGC

GCACCCACACCGGUGAGAAACCGUACAAGUGUCCAGAAUGCGGCAAAAGCUUUAGCGAUCCGGGUCAUCUGGUGCGUCAUCAA

-continued

CGUACGCACACGGGCGAAAAACCGUACAAAUGUCCGGAGUGCGGCAAGAGCUUCAGCCAGAGCAGCAAUCUGGUUCGCCACCA

GCGUACGCACACCGGUGAAAAGCCAUACAAGUGCCCGGAGUGCGGCAAGAGUUUCAGUCGCAAGGACAAUCUGAAGAACCAUC

AACGCACCCAUACGGGCGAGAAGCCGUACAAAUGUCCGGAAUGCGGUAAAAGUUUUAGCCAAGCCGGUCAUCUGGCCAGCCAU

CAGCGUACCCAUACGGGUGAGAAACCGUAUAAAUGUCCAGAAUGUGGUAAGAGUUUCAGCACCAGCGGUAGUCUGGUUCGUCA

UCAACGCACGCAUACGGGUGAAAAACCAACCGGCAAGAAAACCAGC

>ZF4-VPR protein
SEQ ID NO.: 112

MAPKKKRKVGIHGVPAAGSSGSLEPGEKPYKCPECGKSFSQRAHLERHQRTHTGEKPYKCPECGKSFSQLAHLRAHQRTHTGE

KPYKCPECGKSFSSKKHLAEHQRTHTGEKPYKCPECGKSFSTTGALTEHQRTHTGEKPYKCPECGKSFSTSGNLVRHQRTHTG

EKPYKCPECGKSFSQSGDLRRHQRTHTGEKPYKCPECGKSFSTSHSLTEHQRTHTGEKPTGKKTSASGSGGGSGGDALDDFDL

DMLGSDALDDFDLDMLGSDALDDFDLDMLGSDALDDFDLDMLSGGPKKKRKVGSQYLPDTDDRHRIEEKRKRTYETFKSIMKK

SPFSGPTDPRPPPRRIAVPSRSSASVPKPAPQPYPFTSSLSTINYDEFPTMVFPSGQISQASALAPAPPQVLPQAPAPAPAPA

MVSALAQAPAPVPVLAPGPPQAVAPPAPKPTQAGEGTLSEALLQLQFDDEDLGALLGNSTDPAVFTDLASVDNSEFQQLLNQG

IPVAPHTTEPMLMEYPEAITRLVTGAQRPPDPAPAPLGAPGLPNGLLSGDEDFSSIADMDFSALLGSGSGSRDSREGMFLPKP

EAGSAISDVFEGREVCQPKRLRPFHPPGSPWANRPLPASLAPTPTGPVHEPVGSLTPAPVPQPLDPAPAVTPEASHLLEDPDE

ETSQAVKALREMADTVIPQKEEAAICGQMDLSHPPPRGHLDELTTTLESMTEDLNLDSPLTPELNEILDTFLNDECLLHAMHI

STGLSIFDTSLFSGGKRPAATKKAGQAKKKKGSYPYDVPDYA*

>ZF4-mRNA
SEQ ID NO.: 113

AGGAAAUAAGAGAGAAAAGAAGAGUAAGAAGAAAUAUAAGAGCCACCAUGGCCCCCAAGAAGAAGCGGAAGGUGGGCAUCCAC

GGCGUGCCCGCCGCCGGCAGCAGCGGAUCCCUCGAACCGGGCGAAAAGCCGUAUAAGUGCCCGGAAUGCGGCAAGAGUUUUAG

CCAGCGCGCCCAUCUGGAACGUCACCAGCGUACCCAUACCGGUGAAAAGCCAUAUAAAUGCCCAGAAUGUGGUAAAAGCUUUA

GUCAGCUGGCCCAUCUGCGCGCCCACCAACGUACGCACACGGGCGAGAAGCCGUACAAAUGCCCAGAAUGCGGUAAAAGCUUC

AGCAGCAAAAAGCAUCUGGCGGAACAUCAACGUACCCACACCGGCGAGAAACCAUACAAGUGCCCGGAAUGCGGUAAAAGCUU

CAGCACCACCGGUGCGCUGACGGAGCAUCAGCGCACCCACACGGGCGAAAAACCGUAUAAGUGUCCGGAGUGUGGCAAAAGUU

UUAGUACCAGCGGCAAUCUGGUGCGCCAUCAACGUACGCAUACCGGCGAGAAGCCAUAUAAAUGUCCAGAGUGUGGCAAGAGC

UUUAGCCAAAGCGGUGAUCUGCGUCGCCACCAACGCACGCACACCGGCGAAAAACCAUACAAAUGUCCGGAAUGCGGUAAGAG

UUUCAGCACGAGCCAUAGUCUGACCGAACAUCAACGUACCCAUACGGGUGAGAAACCAACCGGCAAGAAAACCAGCGCUAGCG

GCAGCGGCGGCGGCAGCGGCGGCGACGCCCUGGACGACUUCGACCUGGACAUGCUGGGCAGCGACGCCCUGGACGACUUCGAC

CUGGACAUGCUGGGCAGCGACGCCCUGGACGACUUCGACCUGGACAUGCUGGGCAGCGACGCCCUGGACGACUUCGACCUGGA

CAUGCUGAGCGGCGGCCCCAAGAAGAAGCGGAAGGUGGGCAGCCAGUACCUGCCCGACACCGACGACCGGCACCGGAUCGAGG

AGAAGCGGAAGCGGACCUACGAGACCUUCAAGAGCAUCAUGAAGAAAUCCCCCUUCAGCGGCCCCACCGACCCCCGGCCCCCC

CCCCGGCGGAUCGCCGUGCCCAGCCGGAGCAGCGCCAGCGUGCCCAAGCCCGCCCCCCAGCCCUACCCCUUCACCAGCAGCCU

GAGCACCAUCAACUACGACGAGUUCCCCACCAUGGUGUUCCCCAGCGGCCAGAUCAGCCAGGCCAGCGCCCUGGCCCCCGCCC

CCCCCCAGGUGCUGCCCCAGGCCCCCGCCCCCGCCCCCGCCCCCGCCAUGGUGAGCGCCCUGGCCCAGGCCCCCGCCCCCGUG

CCCGUGCUGGCCCCCGGCCCCCCCCAGGCCGUGGCCCCCCCCGCCCCCAAGCCCACCCAGGCCGGCGAGGGCACCCUGAGCGA

GGCCCUGCUGCAGCUGCAGUUCGACGACGAGGACCUGGGCGCCCUGCUGGGCAACAGCACCGACCCCGCCGUGUUCACCGACC

UGGCCAGCGUGGACAACAGCGAGUUCCAGCAGCUGCUGAACCAGGGCAUCCCCGUGGCCCCCCACACCACCGAGCCCAUGCUG

AUGGAGUACCCCGAGGCCAUCACCCGGCUGGUGACCGGCGCCCAGCGGCCCCCCGACCCCGCCCCCGCCCCCCUGGGCGCCCC

CGGCCUGCCCAACGGCCUGCUGAGCGGCGACGAGGACUUCAGCAGCAUCGCCGACAUGGACUUCAGCGCCCUGCUGGGCAGCG

GCAGCGGCAGCCGGGACAGCCGGGAGGGCAUGUUCCUGCCCAAGCCCGAGGCCGGCAGCGCCAUCAGCGACGUGUUCGAGGGC

CGGGAGGUGUGCCAGCCCAAGCGGCUCCGGCCCUUCCACCCCCCCGGCAGCCCCUGGGCCAACCGGCCCCUGCCCGCCAGCCU

GGCCCCCACCCCCACCGGCCCCGUGCACGAGCCCGUGGGCAGCCUGACCCCCGCCCCCGUGCCCCAGCCCCUGGACCCCGCCC

```
CCGCCGUGACCCCCGAGGCCAGCCACCUGCUGGAGGACCCCGACGAGGAGACCAGCCAGGCCGUGAAGGCCCUGCGGGAGAUG

GCCGACACCGUGAUCCCCCAGAAGGAGGAGGCCGCCAUCUGCGGCCAGAUGGACCUGAGCCACCCCCCCCCCGGGGCCACCU

GGACGAGCUGACCACCACCCUGGAGAGCAUGACCGAGGACCUGAACCUGGACAGCCCCCUGACCCCCGAGCUGAACGAGAUCC

UGGACACCUUCCUGAACGACGAGUGCCUGCUGCACGCCAUGCACAUCAGCACCGGCCUGAGCAUCUUCGACACCAGCCUGUUC

AGCGGCGGCAAGCGGCCCGCCGCCACCAAGAAGGCCGGCCAGGCCAAGAAGAAGAAGGGCAGCUACCCCUACGACGUGCCCGA

CUACGCCUGAGCGGCCGCUUAAUUAAGCUGCCUUCUGCGGGGCUUGCCUUCUGGCCAUGCCCUUCUUCUCUCCCUUGCACCUG

UACCUCUUGGUCUUUGAAUAAAGCCUGAGUAGGAAGUCUAGAAAAAAAAAAAAAAAAAAAAAAAAAAAAAAAAAAAAAAAAAA

AAAAAAAAAAAAAAAAAAAAAAAAAAAAAAAAAA
```

>ZF4 target sequence  
SEQ ID NO.: 114  
CCAGCAGATCTTCCCAGAGGA

>ZF4 amino acid sequence  
SEQ ID NO.: 115  
LEPGEKPYKCPECGKSFSQRAHLERHQRTHTGEKPYKCPECGKSFSQLAHLRAHQRTHTGEKPYKCPECGKSFSSKKHLAEHQ RTHTGEKPYKCPECGKSFSTTGALTEHQRTHTGEKPYKCPECGKSFSTSGNLVRHQRTHTGEKPYKCPECGKSFSQSGDLRRH

QRTHTGEKPYKCPECGKSFSTSHSLTEHQRTHTGEKPTGKKTS

>ZF4 mRNA sequence  
SEQ ID NO.: 214  
```
CUCGAACCGGGCGAAAAGCCGUAUAAGUGCCCGGAAUGCGGCAAGAGUUUUAGCCAGCGCGCCCAUCUGGAACGUCACCAGCG UACCCAUACCGGUGAAAAGCCAUAUAAAUGCCCAGAAUGUGGUAAAAGCUUUAGUCAGCUGGCCCAUCUGCGCGCCCACCAAC GUACGCACACGGGCGAGAAGCCGUACAAAUGCCCAGAAUGCGGUAAAAGCUUCAGCAGCAAAAAGCAUCUGGCGGAACAUCAA CGUACCCACACCGGCGAGAAACCAUACAAGUGCCCGGAAUGCGGUAAAAGCUUCAGCACCACCGGUGCGCUGACGGAGCAUCA GCGCACCCACACGGGCGAAAAACCGUAUAAGUGUCCGGAGUGUGGCAAAAGUUUUAGUACCAGCGGCAAUCUGGUGCGCCAUC AACGUACGCAUACCGGCGAGAAGCCAUAUAAAUGUCCAGAGUGUGGCAAGAGCUUUAGCCAAAGCGGUGAUCUGCGUCGCCAC CAACGCACGCACACCGGCGAAAAACCAUACAAAUGUCCGGAAUGCGGUAAGAGUUUCAGCACGAGCCAUAGUCUGACCGAACA

UCAACGUACCCAUACGGGUGAGAAACCAACCGGCAAGAAAACCAGC
```

>ZF5-VPR protein  
SEQ ID NO.: 116  
MAPKKKRKVGIHGVPAAGSSGSLEPGEKPYKCPECGKSFSTSGNLTEHQRTHTGEKPYKCPECGKSFSDSGNLRVHQRTHTGE KPYKCPECGKSFSHKNALQNHQRTHTGEKPYKCPECGKSFSRNDTLTEHQRTHTGEKPYKCPECGKSFSQRAHLERHQRTHTG EKPYKCPECGKSFSRSDKLVRHQRTHTGEKPYKCPECGKSFSDPGHLVRHQRTHTGEKPTGKKTSASGSGGGSGGDALDDFDL DMLGSDALDDFDLDMLGSDALDDFDLDMLGSDALDDFDLDMLSGGPKKKRKVGSQYLPDTDDRHRIEEKRKRTYETFKSIMKK SPFSGPTDPRPPPRRIAVPSRSSASVPKPAPQPYPFTSSLSTINYDEFPTMVFPSGQISQASALAPAPPQVLPQAPAPAPAPA MVSALAQAPAPVPVLAPGPPQAVAPPAPKPTQAGEGTLSEALLQLQFDDEDLGALLGNSTDPAVFTDLASVDNSEFQQLLNQG IPVAPHTTEPMLMEYPEAITRLVTGAQRPPDPAPAPLGAPGLPNGLLSGDEDFSSIADMDFSALLGSGSGSRDSREGMFLPKP EAGSAISDVFEGREVCQPKRLRPFHPPGSPWANRPLPASLAPTPTGPVHEPVGSLTPAPVPQPLDPAPAVTPEASHLLEDPDE ETSQAVKALREMADTVIPQKEEAAICGQMDLSHPPPRGHLDELTTTLESMTEDLNLDSPLTPELNEILDTFLNDECLLHAMHI

STGLSIFDTSLFSGGKRPAATKKAGQAKKKKGSYPYDVPDYA*

>ZF5-VPR mRNA  
SEQ ID NO.: 117  
```
AGGAAAUAAGAGAGAAAAGAAGAGUAAGAAGAAAUAUAAGAGCCACCAUGGCCCCCAAGAAGAAGCGGAAGGUGGGCAUCCAC

GGCGUGCCCGCCGCCGGCAGCAGCGGAUCCCUCGAACCGGGCGAGAAACCAUAUAAGUGUCCAGAGUGUGGUAAGAGCUUUAG

CACCAGUGGCAAUCUGACCGAGCAUCAACGCACGCAUACGGGUGAGAAACCGUACAAGUGCCCGGAAUGCGGCAAAAGUUUCA

GCGAUAGCGGCAAUCUGCGUGUGCACCAGCGUACGCAUACGGGCGAAAAGCCGUAUAAGUGCCCAGAAUGCGGUAAGAGUUUU

AGCCACAAAAACGCGCUGCAGAACCACCAGCGCACCCACACGGGUGAGAAGCCAUACAAAUGUCCGGAAUGCGGCAAAAGCUU
```

-continued

```
CAGCCGCAACGAUACGCUGACGGAACACCAACGUACGCAUACCGGCGAAAAGCCAUACAAGUGCCCGGAGUGCGGUAAAAGCU

UUAGCCAGCGCGCGCAUCUCGAACGUCAUCAACGUACCCAUACCGGUGAAAAACCAUAUAAAUGCCCGGAAUGUGGUAAAAGU

UUUAGCCGCAGCGACAAACUGGUGCGUCAUCAACGCACCCAUACCGGUGAAAAGCCAUAUAAGUGCCCGGAGUGUGGUAAAAG

CUUCAGCGAUCCGGGUCAUCUGGUUCGCCAUCAACGUACGCACACCGGCGAGAAGCCAACCGGCAAGAAAACCAGCGCUAGCG

GCAGCGGCGGCGGCAGCGGCGGCGACGCCCUGGACGACUUCGACCUGGACAUGCUGGGCAGCGACGCCCUGGACGACUUCGAC

CUGGACAUGCUGGGCAGCGACGCCCUGGACGACUUCGACCUGGACAUGCUGGGCAGCGACGCCCUGGACGACUUCGACCUGGA

CAUGCUGAGCGGCGGCCCCAAGAAGAAGCGGAAGGUGGGCAGCCAGUACCUGCCCGACACCGACGACCGGCACCGGAUCGAGG

AGAAGCGGAAGCGGACCUACGAGACCUUCAAGAGCAUCAUGAAGAAAUCCCCCUUCAGCGGCCCCACCGACCCCCGGCCCCCC

CCCCGGCGGAUCGCCGUGCCCAGCCGGAGCAGCGCCAGCGUGCCCAAGCCCGCCCCCAGCCCUACCCCUUCACCAGCAGCCU

GAGCACCAUCAACUACGACGAGUUCCCCACCAUGGUGUUCCCCAGCGGCCAGAUCAGCCAGGCCAGCGCCCUGGCCCCCGCCC

CCCCCCAGGUGCUGCCCCAGGCCCCCGCCCCCGCCCCCGCCCCCGCCAUGGUGAGCGCCCUGGCCCAGGCCCCCGCCCCCGUG

CCCGUGCUGGCCCCCGGCCCCCCCCAGGCCGUGGCCCCCCCCGCCCCCAAGCCCACCCAGGCCGGCGAGGGCACCCUGAGCGA

GGCCCUGCUGCAGCUGCAGUUCGACGACGAGGACCUGGGCGCCCUGCUGGGCAACAGCACCGACCCCGCCGUGUUCACCGACC

UGGCCAGCGUGGACAACAGCGAGUUCCAGCAGCUGCUGAACCAGGGCAUCCCCGUGGCCCCCCACACCACCGAGCCCAUGCUG

AUGGAGUACCCCGAGGCCAUCACCCGGCUGGUGACCGGCGCCCAGCGGCCCCCCGACCCCGCCCCCGCCCCCUGGGCGCCCC

CGGCCUGCCCAACGGCCUGCUGAGCGGCGACGAGGACUUCAGCAGCAUCGCCGACAUGGACUUCAGCGCCCUGCUGGGCAGCG

GCAGCGGCAGCCGGGACAGCCGGGAGGGCAUGUUCCUGCCCAAGCCCGAGGCCGGCAGCGCCAUCAGCGACGUGUUCGAGGGC

CGGGAGGUGUGCCAGCCCAAGCGGCUCCGGCCCUUCCACCCCCCCGGCAGCCCCUGGGCCAACCGGCCCCUGCCCGCCAGCCU

GGCCCCCACCCCCACCGGCCCCGUGCACGAGCCCGUGGGCAGCCUGACCCCCGCCCCCGUGCCCAGCCCCUGGACCCCGCCC

CCGCCGUGACCCCCGAGGCCAGCCACCUGCUGGAGGACCCCGACGAGGAGACCAGCCAGGCCGUGAAGGCCCUGCGGGAGAUG

GCCGACACCGUGAUCCCCCAGAAGGAGGAGGCCGCCAUCUGCGGCCAGAUGGACCUGAGCCACCCCCCCCCCGGGGCCACCU

GGACGAGCUGACCACCACCCUGGAGAGCAUGACCGAGGACCUGAACCUGGACAGCCCCCUGACCCCCGAGCUGAACGAGAUCC

UGGACACCUUCCUGAACGACGAGUGCCUGCUGCACGCCAUGCACAUCAGCACCGGCCUGAGCAUCUUCGACACCAGCCUGUUC

AGCGGCGGCAAGCGGCCCGCCGCCACCAAGAAGGCCGGCCAGGCCAAGAAGAAGAAGGGCAGCUACCCCUACGACGUGCCCGA

CUACGCCUGAGCGGCCGCUUAAUUAAGCUGCCUUCUGCGGGCUUGCCUUCUGGCCAUGCCCUUCUUCUCUCCCUUGCACCUG

UACCUCUUGGUCUUUGAAUAAAGCCUGAGUAGGAAGUCUAGAAAAAAAAAAAAAAAAAAAAAAAAAAAAAAAAAAAAAAAAA

AAAAAAAAAAAAAAAAAAAAAAAAAAAAAAAAA
```

>ZF5 target sequence

SEQ ID NO.: 118

GGCGGGGGACCGATTAACCAT

>ZF5 amino acid sequence

SEQ ID NO.: 119

LEPGEKPYKCPECGKSFSTSGNLTEHQRTHTGEKPYKCPECGKSFSDSGNLRVHQRTHTGEKPYKCPECGKSFSHKNALQNHQ

RTHTGEKPYKCPECGKSFSRNDTLTEHQRTHTGEKPYKCPECGKSFSQRAHLERHQRTHTGEKPYKCPECGKSFSRSDKLVRH

QRTHTGEKPYKCPECGKSFSDPGHLVRHQRTHTGEKPTGKKTS

>ZF5 mRNA sequence

SEQ ID NO.: 215

CUCGAACCGGGCGAGAAACCAUAUAAGUGUCCAGAGUGUGGUAAGAGCUUUAGCACCAGUGGCAAUCUGACCGAGCAUCAACG

CACGCAUACGGGUGAGAAACCGUACAAGUGCCCGGAAUGCGGCAAAAGUUUCAGCGAUAGCGGCAAUCUGCGUGUGCACCAGC

GUACGCAUACGGGCGAAAAGCCGUAUAAGUGCCCAGAAUGCGGUAAGAGUUUUAGCCACAAAAACGCGCUGCAGAACCACCAG

CGCACCCACACGGGUGAGAAGCCAUACAAAUGUCCGGAAUGCGGCAAAAGCUUCAGCCGCAACGAUACGCUGACGGAACACCA

ACGUACGCAUACCGGCGAAAAGCCAUACAAGUGCCCGGAGUGCGGUAAAAGCUUUAGCCAGCGCGCGCAUCUCGAACGUCAUC

```
AACGUACCCAUACCGGUGAAAAACCAUAUAAAUGCCCGGAAUGUGGUAAAAGUUUUAGCCGCAGCGACAAACUGGUGCGUCAU

CAACGCACCCAUACCGGUGAAAAGCCAUAUAAGUGCCCGGAGUGUGGUAAAAGCUUCAGCGAUCCGGGUCAUCUGGUUCGCCA

UCAACGUACGCACACCGGCGAGAAGCCAACCGGCAAGAAAACCAGC
```

>ZF6-VPR protein

SEQ ID NO.: 120

```
MAPKKKRKVGIHGVPAAGSSGSLEPGEKPYKCPECGKSFSTSHSLTEHQRTHTGEKPYKCPECGKSFSQRANLRAHQRTHTGE

KPYKCPECGKSFSRADNLTEHQRTHTGEKPYKCPECGKSFSERSHLREHQRTHTGEKPYKCPECGKSFSDPGALVRHQRTHTG

EKPYKCPECGKSFSTSGHLVRHQRTHTGEKPYKCPECGKSFSRNDTLTEHQRTHTGEKPTGKKTSASGSGGGSGGDALDDFDL

DMLGSDALDDFDLDMLGSDALDDFDLDMLGSDALDDFDLDMLSGGPKKKRKVGSQYLPDTDDRHRIEEKRKRTYETFKSIMKK

SPFSGPTDPRPPPRRIAVPSRSSASVPKPAPQPYPFTSSLSTINYDEFPTMVFPSGQISQASALAPAPPQVLPQAPAPAPAPA

MVSALAQAPAPVPVLAPGPPQAVAPPAPKPTQAGEGTLSEALLQLQFDDEDLGALLGNSTDPAVFTDLASVDNSEFQQLLNQG

IPVAPHTTEPMLMEYPEAITRLVTGAQRPPDPAPAPLGAPGLPNGLLSGDEDFSSIADMDFSALLGSGSGSRDSREGMFLPKP

EAGSAISDVFEGREVCQPKRLRPFHPPGSPWANRPLPASLAPTPTGPVHEPVGSLTPAPVPQPLDPAPAVTPEASHLLEDPDE

ETSQAVKALREMADTVIPQKEEAAICGQMDLSHPPPRGHLDELTTTLESMTEDLNLDSPLTPELNEILDTFLNDECLLHAMHI

STGLSIFDTSLFSGGKRPAATKKAGQAKKKKGSYPYDVPDYA*
```

>ZF6-VPR mRNA

SEQ ID NO.: 121

```
AGGAAAUAAGAGAGAAAAGAAGAGUAAGAAGAAAUAUAAGAGCCACCAUGGCCCCCAAGAAGAAGCGGAAGGUGGGCAUCCAC

GGCGUGCCCGCCGCCGGCAGCAGCGGAUCCCUCGAACCGGGCGAAAAACCGUAUAAGUGUCCGGAGUGCGGCAAGAGCUUCAG

CACGAGCCAUAGUCUGACCGAACACCAGCGCACCCACACGGGCGAAAAGCCGUACAAAUGUCCAGAGUGUGGUAAGAGUUUCA

GCCAGCGUGCCAAUCUGCGCGCCCACCAACGUACCCACACCGGUGAGAAGCCGUAUAAGUGCCCAGAGUGUGGUAAAAGCUUC

AGCCGCGCCGAUAAUCUGACGGAGCACCAACGCACCCACACCGGCGAAAAGCCAUACAAGUGCCCGGAGUGUGGCAAGAGCUU

UAGCGAACGCAGCCAUCUGCGCGAACACCAACGUACGCACACGGGUGAGAAACCAUACAAAUGUCCAGAAUGUGGUAAAAGUU

UUAGCGAUCCGGGCGCGCUGGUUCGCCACCAGCGCACGCACACCGGUGAAAAGCCGUAUAAAUGUCCAGAAUGCGGCAAAAGC

UUCAGUACCAGCGGUCAUCUGGUUCGUCAUCAGCGUACCCAUACCGGCGAGAAGCCAUAUAAGUGCCCGGAGUGUGGCAAAAG

UUUCAGCCGCAAUGAUACGCUGACCGAGCAUCAGCGUACGCAUACCGGUGAAAAACCAACCGGCAAGAAAACCAGCGCUAGCG

GCAGCGGCGGCGGCAGCGGCGGCGACGCCCUGGACGACUUCGACCUGGACAUGCUGGGCAGCGACGCCCUGGACGACUUCGAC

CUGGACAUGCUGGGCAGCGACGCCCUGGACGACUUCGACCUGGACAUGCUGGGCAGCGACGCCCUGGACGACUUCGACCUGGA

CAUGCUGAGCGGCGGCCCCAAGAAGAAGCGGAAGGUGGGCAGCCAGUACCUGCCCGACACCGACGACCGGCACCGGAUCGAGG

AGAAGCGGAAGCGGACCUACGAGACCUUCAAGAGCAUCAUGAAGAAAUCCCCCUUCAGCGGCCCCACCGACCCCCGGCCCCCC

CCCCGGCGGAUCGCCGUGCCCAGCCGGAGCAGCGCCAGCGUGCCCAAGCCCGCCCCCCAGCCCUACCCCUUCACCAGCAGCCU

GAGCACCAUCAACUACGACGAGUUCCCCACCAUGGUGUUCCCCAGCGGCCAGAUCAGCCAGGCCAGCGCCCUGGCCCCCGCCC

CCCCCCAGGUGCUGCCCCAGGCCCCCGCCCCCGCCCCCGCCCCCGCCAUGGUGAGCGCCCUGGCCCAGGCCCCCGCCCCCGUG

CCCGUGCUGGCCCCCGGCCCCCCCCAGGCCGUGGCCCCCCCCGCCCCCAAGCCCACCCAGGCCGGCGAGGGCACCCUGAGCGA

GGCCCUGCUGCAGCUGCAGUUCGACGACGAGGACCUGGGCGCCCUGCUGGGCAACAGCACCGACCCCGCCGUGUUCACCGACC

UGGCCAGCGUGGACAACAGCGAGUUCCAGCAGCUGCUGAACCAGGGCAUCCCCGUGGCCCCCACACCACCGAGCCCAUGCUG

AUGGAGUACCCCGAGGCCAUCACCCGGCUGGUGACCGGCGCCCAGCGGCCCCCCGACCCCGCCCCCGCCCCCCUGGGCGCCCC

CGGCCUGCCCAACGGCCUGCUGAGCGGCGACGAGGACUUCAGCAGCAUCGCCGACAUGGACUUCAGCGCCCUGCUGGGCAGCG

GCAGCGGCAGCCGGGACAGCCGGGAGGGCAUGUUCCUGCCCAAGCCCGAGGCCGGCAGCGCCAUCAGCGACGUGUUCGAGGGC

CGGGAGGUGUGCCAGCCCAAGCGGCUCCGGCCCUUCCACCCCCCGGCAGCCCCUGGGCCAACCGGCCCCUGCCCGCCAGCCU

GGCCCCCACCCCCACCGGCCCCGUGCACGAGCCCGUGGGCAGCCUGACCCCCGCCCCCGUGCCCAGCCCCCUGGACCCCGCCC

CCGCCGUGACCCCCGAGGCCAGCCACCUGCUGGAGGACCCCGACGAGGAGACCAGCCAGGCCGUGAAGGCCCUCUGCGGGAGAUG
```

```
GCCGACACCGUGAUCCCCCAGAAGGAGGAGGCCGCCAUCUGCGGCCAGAUGGACCUGAGCCACCCCCCCCCCGGGGCCACCU

GGACGAGCUGACCACCACCCUGGAGAGCAUGACCGAGGACCUGAACCUGGACAGCCCCCUGACCCCCGAGCUGAACGAGAUCC

UGGACACCUUCCUGAACGACGAGUGCCUGCUGCACGCCAUGCACAUCAGCACCGGCCUGAGCAUCUUCGACACCAGCCUGUUC

AGCGGCGGCAAGCGGCCCGCCGCCACCAAGAAGGCCGGCCAGGCCAAGAAGAAGAAGGGCAGCUACCCCUACGACGUGCCCGA

CUACGCCUGAGCGGCCGCUUAAUUAAGCUGCCUUCUGCGGGGCUUGCCUUCUGGCCAUGCCCUUCUUCUCUCCCUUGCACCUG

UACCUCUUGGUCUUUGAAUAAAGCCUGAGUAGGAAGUCUAGAAAAAAAAAAAAAAAAAAAAAAAAAAAAAAAAAAAAAAAAAA

AAAAAAAAAAAAAAAAAAAAAAAAAAAAAAAAAA
```

>ZF6 target sequence
SEQ ID NO.: 122
```
CCGGGTGTCAGCCAGAAACCA
```

>ZF6 amino acid sequence
SEQ ID No.: 123
```
LEPGEKPYKCPECGKSFSTSHSLTEHQRTHTGEKPYKCPECGKSFSQRANLRAHQRTHTGEKPYKCPECGKSFSRADNLTEHQ RTHTGEKPYKCPECGKSFSERSHLREHQRTHTGEKPYKCPECGKSFSDPGALVRHQRTHTGEKPYKCPECGKSFSTSGHLVRH

QRTHTGEKPYKCPECGKSFSRNDTLTEHQRTHTGEKPTGKKTS
```

>ZF6 mRNA sequence
SEQ ID NO.: 216
```
CUCGAACCGGGCGAAAAACCGUAUAAGUGUCCGGAGUGCGGCAAGAGCUUCAGCACGAGCCAUAGUCUGACCGAACACCAGCG CACCCACACGGGCGAAAAGCCGUACAAAUGUCCAGAGUGUGGUAAGAGUUUCAGCCAGCGUGCCAAUCUGCGCGCCCACCAAC GUACCCACACCGGUGAGAAGCCGUAUAAGUGCCCAGAGUGUGGUAAAAGCUUCAGCCGCGCCGAUAAUCUGACGGAGCACCAA CGCACCCACACCGGCGAAAAGCCAUACAAGUGCCCGGAGUGUGGCAAGAGCUUUAGCGAACGCAGCCAUCUGCGCGAACACCA ACGUACGCACACGGGUGAGAAACCAUACAAAUGUCCAGAUGUGGUAAAAGUUUUAGCGAUCCGGGCGCGCUGGUUCGCCACC AGCGCACGCACACCGGUGAAAAGCCGUAUAAAUGUCCAGAAUGCGGCAAAAGCUUCAGUACCAGCGGUCAUCUGGUUCGUCAU CAGCGUACCCAUACCGGCGAGAAGCCAUAUAAGUGCCCGGAGUGUGGCAAAAGUUUCAGCCGCAAUGAUACGCUGACCGAGCA

UCAGCGUACGCAUACCGGUGAAAAACCAACCGGCAAGAAAACCAGC
```

>ZF7-VPR protein
SEQ ID NO.: 124
```
MAPKKKRKVGIHGVPAAGSSGSLEPGEKPYKCPECGKSFSRSDHLTNHQRTHTGEKPYKCPECGKSFSTSGSLVRHQRTHTGE KPYKCPECGKSFSQAGHLASHQRTHTGEKPYKCPECGKSFSRSDKLTEHQRTHTGEKPYKCPECGKSFSTSGNLTEHQRTHTG EKPYKCPECGKSFSQSSNLVRHQRTHTGEKPYKCPECGKSFSTHLDLIRHQRTHTGEKPTGKKTSASGSGGGSGGDALDDFDL DMLGSDALDDFDLDMLGSDALDDFDLDMLGSDALDDFDLDMLSGGPKKKRKVGSQYLPDTDDRHRIEEKRKRTYETFKSIMKK SPFSGPTDPRPPPRRIAVPSRSSASVPKPAPQPYPFTSSLSTINYDEFPTMVFPSGQISQASALAPAPPQVLPQAPAPAPAPA MVSALAQAPAPVPVLAPGPPQAVAPPAPKPTQAGEGTLSEALLQLQFDDEDLGALLGNSTDPAVFTDLASVDNSEFQQLLNQG IPVAPHTTEPMLMEYPEAITRLVTGAQRPPDPAPAPLGAPGLPNGLLSGDEDFSSIADMDFSALLGSGSGSRDSREGMFLPKP EAGSAISDVFEGREVCQPKRLRPFHPPGSPWANRPLPASLAPTPTGPVHEPVGSLTPAPVPQPLDPAPAVTPEASHLLEDPDE ETSQAVKALREMADTVIPQKEEAAICGQMDLSHPPPRGHLDELTTTLESMTEDLNLDSPLTPELNEILDTFLNDECLLHAMHI

STGLSIFDTSLFSGGKRPAATKKAGQAKKKKGSYPYDVPDYA*
```

>ZF7-VPR mRNA
SEQ ID No.: 125
```
AGGAAAUAAGAGAGAAAAGAAGAGUAAGAAGAAAUAUAAGAGCCACCAUGGCCCCCAAGAAGAAGCGGAAGGUGGGCAUCCAC

GGCGUGCCCGCCGCCGGCAGCAGCGGAUCCCUGGAACCGGGCGAGAAGCCAUACAAGUGCCCAGAGUGCGGCAAAAGCUUCAG

CCGCAGCGACCAUCUGACCAAUCACCAACGCACCCAUACCGGUGAGAAGCCGUACAAAUGCCCAGAGUGCGGUAAGAGCUUUA

GUACCAGUGGCAGUCUGGUUCGUCAUCAGCGCACGCACACGGGCGAAAAACCAUACAAAUGCCCGGAGUGCGGCAAAAGCUUU

AGCCAAGCCGGUCAUCUGGCGAGCCAUCAACGUACGCACACCGGCGAGAAGCCGUAUAAAUGUCCGGAGUGCGGUAAGAGCUU

UAGCCGUAGCGAUAAACUGACCGAACACCAACGUACGCAUACGGGCGAGAAACCAUAUAAAUGUCCAGAGUGUGGCAAGAGUU

UCAGCACCAGCGGCAAUCUGACCGAGCAUCAACGUACCCAUACCGGUGAAAAGCCAUAUAAAUGUCCAGAAUGCGGUAAGAGU
```

-continued

```
UUUAGUCAGAGCAGUAAUCUGGUGCGCCAUCAGCGUACCCACACGGGUGAGAAACCAUAUAAGUGUCCGGAAUGCGGCAAGAG
UUUUAGCACCCAUCUGGAUCUGAUCCGUCAUCAGCGCACCCACACCGGUGAAAAACCAACCGGCAAGAAAACCAGUGCUAGCG
GCAGCGGCGGCGGCAGCGGCGGCGACGCCCUGGACGACUUCGACCUGGACAUGCUGGGCAGCGACGCCCUGGACGACUUCGAC
CUGGACAUGCUGGGCAGCGACGCCCUGGACGACUUCGACCUGGACAUGCUGGGCAGCGACGCCCUGGACGACUUCGACCUGGA
CAUGCUGAGCGGCGGCCCCAAGAAGAAGCGGAAGGUGGGCAGCCAGUACCUGCCCGACACCGACGACCGGCACCGGAUCGAGG
AGAAGCGGAAGCGGACCUACGAGACCUUCAAGAGCAUCAUGAAGAAAUCCCCCUUCAGCGGCCCCACCGACCCCCGGCCCCCC
CCCCGGCGGAUCGCCGUGCCCAGCCGGAGCAGCGCCAGCGUGCCCAAGCCCGCCCCCAGCCCUACCCCUUCACCAGCAGCCU
GAGCACCAUCAACUACGACGAGUUCCCCACCAUGGUGUUCCCCAGCGGCCAGAUCAGCCAGGCCAGCGCCCUGGCCCCCGCCC
CCCCCCAGGUGCUGCCCCAGGCCCCCGCCCCCGCCCCCGCCCCCGCCAUGGUGAGCGCCCUGGCCCAGGCCCCCGCCCCCGUG
CCCGUGCUGGCCCCCGGCCCCCCCCAGGCCGUGGCCCCCCCCGCCCCCAAGCCCACCCAGGCCGGCGAGGGCACCCUGAGCGA
GGCCCUGCUGCAGCUGCAGUUCGACGACGAGGACCUGGGCGCCCUGCUGGGCAACAGCACCGACCCCGCCGUGUUCACCGACC
UGGCCAGCGUGGACAACAGCGAGUUCCAGCAGCUGCUGAACCAGGGCAUCCCCGUGGCCCCCCACACCACCGAGCCCAUGCUG
AUGGAGUACCCCGAGGCCAUCACCCGGCUGGUGACCGGCGCCCAGCGGCCCCCCGACCCCGCCCCCGCCCCCUGGGCGCCCC
CGGCCUGCCCAACGGCCUGCUGAGCGGCGACGAGGACUUCAGCAGCAUCGCCGACAUGGACUUCAGCGCCCUGCUGGGCAGCG
GCAGCGGCAGCCGGGACAGCCGGGAGGGCAUGUUCCUGCCCAAGCCCGAGGCCGGCAGCGCCAUCAGCGACGUGUUCGAGGGC
CGGGAGGUGUGCCAGCCCAAGCGGCUCCGGCCCUUCCACCCCCCCGGCAGCCCCUGGGCCAACCGGCCCCUGCCCGCCAGCCU
GGCCCCCACCCCCACCGGCCCCGUGCACGAGCCCGUGGGCAGCCUGACCCCCGCCCCCGUGCCCAGCCCCUGGACCCCGCCC
CCGCCGUGACCCCCGAGGCCAGCCACCUGCUGGAGGACCCCGACGAGGAGACCAGCCAGGCCGUGAAGGCCCUGCGGGAGAUG
GCCGACACCGUGAUCCCCCAGAAGGAGGAGGCCGCCAUCUGCGGCCAGAUGGACCUGAGCCACCCCCCCCCCGGGGCCACCU
GGACGAGCUGACCACCACCCUGGAGAGCAUGACCGAGGACCUGAACCUGGACAGCCCCCUGACCCCCGAGCUGAACGAGAUCC
UGGACACCUUCCUGAACGACGAGUGCCUGCUGCACGCCAUGCACAUCAGCACCGGCCUGAGCAUCUUCGACACCAGCCUGUUC
AGCGGCGGCAAGCGGCCCGCCGCCACCAAGAAGGCCGGCCAGGCCAAGAAGAAGAAGGGCAGCUACCCCUACGACGUGCCCGA
CUACGCCUGAGCGGCCGCUUAAUUAAGCUGCCUUCUGCGGGGCUUGCCUUCUGGCCAUGCCCUUCUUCUCUCCCUUGCACCUG
UACCUCUUGGUCUUUGAAUAAAGCCUGAGUAGGAAGUCUAGAAAAAAAAAAAAAAAAAAAAAAAAAAAAAAAAAAAAAAAAAAA
AAAAAAAAAAAAAAAAAAAAAAAAAAAAAAAAAAA
>ZF7.4-VPR mRNA sequence
                                                              SEQ ID NO.: 2508
AGGAAAUAAGAGAGAAAAGAAGAGUAAGAAGAAAUAUAAGAGCCACCAUGGCCCCGAAGAAAAAGAGGAAGGUCGGGAUCCAC
GGAGUCCCAGCCGCAGGAAGCAGCGGAAGCCUGGAACCCGGAGAAAAACCCUACAAGUGCCCAGAAUGCGGCAAGAGCUUCAG
CCGCAGCGACCACCUGACCAACCACCAGAGAACCCACACCGGAGAAAAGCCAUACAAAUGCCCAGAGUGCGGGAAAAGCUUCA
GCACAAGCGGCAGCCUCGUCAGGCACCAGCGGACACACACCGGCGAGAAGCCCUACAAGUGCCCGGAAUGCGGAAAGAGCUUC
AGCCAAGCCGGACACCUCGCCAGCCACCAGAGGACCCACACAGGAGAGAAACCGUACAAAUGCCCGGAGUGCGGCAAGAGCUU
CAGCCGGAGCGACAAGCUGACCGAACACCAGCGAACCCACACGGGCGAAAAGCCGUACAAGUGCCCCGAGUGCGGAAAAAGCU
UCAGCACGAGCGGAAACCUCACCGAGCACCAGCGCACCCACACGGGAGAGAAGCCGUACAAGUGCCCCGAAUGCGGAAAGAGC
UUCAGCCAGAGCAGCAACCUCGUGCGCCACCAACGGACGCACACAGGGGAAAAGCCCUACAAGUGCCCGGAAUGCGGCAAAAG
CUUCAGCACCCACCUGGACCUGAUCCGGCACCAACGCACGCACACCGGGAAAAACCGACCGGAAAAAGACCAGCGCGAGCG
GAAGCGGAGGAGGAAGCGGAGGCGACGCCCUGGACGACUUCGACCUGGACAUGCUGGGGAGCGACGCACUGGACGACUUCGAC
CUGGACAUGCUGGGAAGCGACGCGCUGGACGACUUCGACCUGGACAUGCUGGGCAGCGACGCCCUCGACGACUUCGACCUCGA
CAUGCUGAGCGGCGGACCCAAGAAGAAGAGAAAGGUCGGAAGCCAGUACCUCCCGGACACCGACGACAGGCACCGCAUCGAAG
AGAAGCGGAAAAGAACCUACGAAACCUUCAAGAGCAUCAUGAAAAAGAGCCCGUUCAGCGGACCAACCGACCCCAGACCACCA
CCGAGAAGAAUCGCGGUCCCAAGCAGGAGCAGCGCCAGCGUCCCGAAGCCAGCCCCACAGCCGUACCCCUUCACCAGCAGCCU
```

```
                                      -continued
GAGCACCAUCAACUACGACGAGUUCCCCACCAUGGUGUUCCCGAGCGGCCAGAUAAGCCAGGCCAGCGCACUGGCACCAGCCC
CACCGCAAGUGCUGCCCCAAGCACCCGCACCAGCACCCGCCCCCGCGAUGGUCAGCGCCCUGGCACAAGCCCCAGCCCCAGUC
CCGGUGCUCGCACCAGGACCACCCCAAGCAGUCGCACCGCCAGCCCCAAAGCCGACCCAAGCCGGAGAAGGCACCCUCAGCGA
GGCGCUCCUGCAACUCCAAUUCGACGACGAGGACCUGGGAGCCCUGCUGGGCAACAGCACCGACCCGGCAGUGUUCACCGACC
UGGCCAGCGUGGACAACAGCGAAUUCCAGCAGCUCCUGAACCAAGGAAUCCCAGUCGCGCCACACACCACCGAGCCGAUGCUG
AUGGAAUACCCAGAAGCGAUCACGAGACUGGUCACCGGGGCCCAAAGACCGCCGGACCCAGCCGCCAGCACCACUGGGAGCCCC
AGGACUGCCCAACGGACUGCUCAGCGGCGACGAGGACUUCAGCAGCAUCGCGGACAUGGACUUCAGCGCACUCCUCGGAAGCG
GAAGCGGCAGCAGAGACAGCCGGGAAGGAAUGUUCCUCCCCAAGCCAGAAGCCGAAGCGCAAUCAGCGACGUGUUCGAAGGA
CGGGAAGUCUGCCAGCCGAAGCGCCUCAGACCGUUCCACCCACCGGGAAGCCCAUGGGCAACAGACCGCUGCCAGCCAGCCU
GGCACCGACCCCAACCGGACCAGUCCACGAACCAGUCGGCAGCCUGACACCAGCACCAGUGCCCCAGCCACUGGACCCAGCAC
CGGCAGUGACCCCAGAAGCCAGCCACCUCCUGGAGGACCCCGACGAAGAAACCAGCCAGGCCGUGAAGGCCCUGAGGGAGAUG
GCCGACACGGUGAUCCCACAGAAGGAAGAAGCAGCGAUCUGCGGCCAAAUGGACCUCAGCCACCCACCGCCAAGAGGCCACCU
GGACGAGCUCACCACCACCCUGGAAAGCAUGACCGAGGACCUCAACCUCGACAGCCCCCUGACACCGGAGCUCAACGAGAUCC
UGGACACCUUCCUCAACGACGAAUGCCUGCUCCACGCCAUGCACAUCAGCACCGGACUGAGCAUCUUCGACACCAGCCUGUUC
AGCGGGGGAAAACGACCGGCAGCCACCAAAAAGGCCGGACAGGCGAAGAAGAAGAAGGGGAGCUACCCCGUACGACGUGCCCGA
CUACGCCUGAGCGGCCGCUUAAUUAAGCUGCCUUCUGCGGGCUUGCCUUCUGGCCAUGCCCUUCUUCUCUCCCUUGCACCUG
UACCUCUUGGUCUUUGAAUAAAGCCUGAGUAGGAAGUCUAGAAAAAAAAAAAAAAAAAAAAAAAAAAAAAAAAAAAAAAAAAA
AAAAAAAAAAAAAAAAAAAAAAAAAAAAAAAAAAAAAAAAAAAAAAAAAAAAAAAAAAAAAA >ZF7 target sequence
                                                                          SEQ ID NO.: 126
ACTGAACATCGGTGAGTTAGG >ZF7 amino acid sequence
                                                                          SEQ ID NO.: 127
LEPGEKPYKCPECGKSFSRSDHLTNHQRTHTGEKPYKCPECGKSFSTSGSLVRHQRTHTGEKPYKCPECGKSFSQAGHLASHQ
RTHTGEKPYKCPECGKSFSRSDKLTEHQRTHTGEKPYKCPECGKSFSTSGNLTEHQRTHTGEKPYKCPECGKSFSQSSNLVRH
QRTHTGEKPYKCPECGKSFSTHLDLIRHQRTHTGEKPTGKKTS >ZF7 mRNA
                                                                          SEQ ID NO.: 217
CUGGAACCGGGCGAGAAGCCAUACAAGUGCCCAGAGUGCGGCAAAAGCUUCAGCCGCAGCGACCAUCUGACCAAUCACCAACG
CACCCAUACCGGUGAGAAGCCGUACAAAUGCCCAGAGUGCGGUAAGAGCUUUAGUACCAGUGGCAGUCUGGUUCGUCAUCAGC
GCACGCACACGGGCGAAAAACCAUACAAAUGCCCGGAGUGCGGCAAAAGCUUUAGCCAAGCCGGUCAUCUGGCGAGCCAUCAA
CGUACGCACACCGGCGAGAAGCCGUAUAAAUGUCCGGAGUGCGGUAAGAGCUUUAGCCGUAGCGAUAAACUGACCGAACACCA
ACGUACGCAUACGGGCGAGAAACCAUAUAAAUGUCCAGAGUGUGGCAAGAGUUUCAGCACCAGCGGCAAUCUGACCGAGCAUC
AACGUACCCAUACCGGUGAAAAGCCAUAUAAAUGUCCAGAAUGCGGUAAGAGUUUUAGUCAGAGCAGUAAUCUGGUGCGCCAU
CAGCGUACCCACACGGGUGAGAAACCAUAUAAGUGUCCGGAAUGCGGCAAGAGUUUUAGCACCCAUCUGGAUCUGAUCCGUCA
UCAGCGCACCCACACCGGUGAAAAACCAACCGGCAAGAAAACCAGU >ZF7.4 mRNA sequence
                                                                          SEQ ID NO.: 2509
CUGGAACCCGGAGAAAAACCCUACAAGUGCCCAGAAUGCGGCAAGAGCUUCAGCCGCAGCGACCACCUGACCAACCACCAGAG
AACCCACACCGGAGAAAAGCCAUACAAAUGCCCAGAGUGCGGGAAAAGCUUCAGCACAAGCGGCAGCCUCGUCAGGCACCAGC
GGACACACACCGGCGAGAAGCCCUACAAGUGCCCGGAAUGCGGAAAGAGCUUCAGCCAAGCCGGACACCUCGCCAGCCACCAG
AGGACCCACACAGGAGAGAAACCGUACAAAUGCCCGGAGUGCGGCAAGAGCUUCAGCCGGAGCGACAAGCUGACCGAACACCA
GCGAACCCACACGGGCGAAAAGCCGUACAAGUGCCCCGAGUGCGGAAAAAGCUUCAGCACGAGCGGAAACCUCACCGAGCACC
AGCGCACCCACACGGGAGAGAAGCCGUACAAGUGCCCCGAAUGCGGAAAGAGCUUCAGCCAGAGCAGCAACCUCGUGCGCCAC
```

-continued

```
CAACGGACGCACACAGGGGAAAAGCCCUACAAGUGCCCGGAAUGCGGCAAAAGCUUCAGCACCCACCUGGACCUGAUCCGGCA
CCAACGCACGCACACCGGGGAAAAACCGACCGGAAAAAGACCAGC
```

>ZF8-VPR protein

SEQ ID NO.: 128

```
MAPKKKRKVGIHGVPAAGSSGSLEPGEKPYKCPECGKSFSRSDHLTTHQRTHTGEKPYKCPECGKSFSTSGELVRHQRTHTGE
KPYKCPECGKSFSRRDELNVHQRTHTGEKPYKCPECGKSFSSPADLTRHQRTHTGEKPYKCPECGKSFSRSDELVRHQRTHTG
EKPYKCPECGKSFSRSDKLVRHQRTHTGEKPYKCPECGKSFSTTGALTEHQRTHTGEKPTGKKTSASGSGGGSGGDALDDFDL
DMLGSDALDDFDLDMLGSDALDDFDLDMLGSDALDDFDLDMLSGGPKKKRKVGSQYLPDTDDRHRIEEKRKRTYETFKSIMKK
SPFSGPTDPRPPPRRIAVPSRSSASVPKPAPQPYPFTSSLSTINYDEFPTMVFPSGQISQASALAPAPPQVLPQAPAPAPAPA
MVSALAQAPAPVPVLAPGPPQAVAPPAPKPTQAGEGTLSEALLQLQFDDEDLGALLGNSTDPAVFTDLASVDNSEFQQLLNQG
IPVAPHTTEPMLMEYPEAITRLVTGAQRPPDPAPAPLGAPGLPNGLLSGDEDFSSIADMDFSALLGSGSGSRDSREGMFLPKP
EAGSAISDVFEGREVCQPKRLRPFHPPGSPWANRPLPASLAPTPTGPVHEPVGSLTPAPVPQPLDPAPAVTPEASHLLEDPDE
ETSQAVKALREMADTVIPQKEEAAICGQMDLSHPPPRGHLDELTTTLESMTEDLNLDSPLTPELNEILDTFLNDECLLHAMHI
STGLSIFDTSLFSGGKRPAATKKAGQAKKKKGSYPYDVPDYA*
```

>ZF8-VPR mRNA

SEQ ID No.: 129

```
AGGAAAUAAGAGAGAAAAGAAGAGUAAGAAGAAAUAUAAGAGCCACCAUGGCCCCCAAGAAGAAGCGGAAGGUGGGCAUCCAC
GGCGUGCCCGCCGCCGGCAGCAGCGGAUCCCUGGAACCGGGCGAAAAGCCGUACAAGUGCCCGGAAUGUGGCAAAAGUUUUAG
UCGCAGCGAUCAUCUGACCACCCAUCAGCGUACCCAUACCGGUGAGAAGCCAUACAAAUGCCCAGAAUGUGGUAAGAGCUUUA
GCACCAGCGGCGAGCUGGUUCGUCACCAGCGUACCCACACCGGCGAGAAGCCGUAUAAGUGUCCAGAAUGCGGUAAAAGCUUU
AGCCGCCGCGACGAGCUGAAUGUGCAUCAACGCACCCACACGGGCGAGAAGCCAUAUAAGUGCCCGGAGUGUGGUAAGAGUUU
CAGUAGCCCAGCGGAUCUGACCCCGUCAUCAACGUACGCACACGGGCGAGAAACCAUACAAGUGUCCGGAGUGCGGCAAAAGUU
UUAGCCGCAGUGAUGAACUGGUGCGCCACCAGCGCACCCAUACCGGCGAAAAACCGUAUAAGUGCCCAGAGUGCGGUAAGAGC
UUCAGCCGCAGCGACAAACUGGUGCGUCACCAGCGCACGCAUACGGGUGAGAAACCGUACAAGUGCCCGGAGUGCGGCAAAAG
CUUCAGCACCACCGGCGCGCUGACCGAACAUCAACGUACCCAUACGGGUGAGAAACCAACGGGCAAAAGACCAGCGCUAGCG
GCAGCGGCGGCGGCAGCGGCGGCGACGCCCUGGACGACUUCGACCUGGACAUGCUGGGCAGCGACGCCCUGGACGACUUCGAC
CUGGACAUGCUGGGCAGCGACGCCCUGGACGACUUCGACCUGGACAUGCUGGGCAGCGACGCCCUGGACGACUUCGACCUGGA
CAUGCUGAGCGGCGGCCCCAAGAAGAAGCGGAAGGUGGGCAGCCAGUACCUGCCCGACACCGACGACCGGCACCGGAUCGAGG
AGAAGCGGAAGCGGACCUACGAGACCUUCAAGAGCAUCAUGAAGAAAUCCCCCUUCAGCGGCCCCACCGACCCCCGGCCCCCC
CCCCGGCGGAUCGCCGUGCCCAGCCGGAGCAGCGCCAGCGUGCCCAAGCCCGCCCCCAGCCCUACCCCUUCACCAGCAGCCU
GAGCACCAUCAACUACGACGAGUUCCCCACCAUGGUGUUCCCCAGCGGCCAGAUCAGCCAGGCCAGCGCCCUGGCCCCCGCCC
CCCCCCAGGUGCUGCCCCAGGCCCCCGCCCCCGCCCCCGCCCCCGCCAUGGUGAGCGCCCUGGCCCAGGCCCCCGCCCCCGUG
CCCGUGCUGGCCCCCGGCCCCCCCCAGGCCGUGGCCCCCCCCGCCCCCAAGCCCACCCAGGCCGGCGAGGGCACCCUGAGCGA
GGCCCUGCUGCAGCUGCAGUUCGACGACGAGGACCUGGGCGCCCUGCUGGGCAACAGCACCGACCCCGCCGUGUUCACCGACC
UGGCCAGCGUGGACAACAGCGAGUUCCAGCAGCUGCUGAACCAGGGCAUCCCCGUGGCCCCCACACCACCGAGCCCAUGCUG
AUGGAGUACCCCGAGGCCAUCACCCGGCUGGUGACCGGCGCCCAGCGGCCCCCCGACCCCGCCCCCGCCCCCCUGGGCGCCCC
CGGCCUGCCCAACGGCCUGCUGAGCGGCGACGAGGACUUCAGCAGCAUCGCCGACAUGGACUUCAGCGCCCUGCUGGGCAGCG
GCAGCGGCAGCCGGGACAGCCGGGAGGGCAUGUUCCUGCCCAAGCCCGAGGCCGGCAGCGCCAUCAGCGACGUGUUCGAGGGC
CGGGAGGUGUGCCAGCCCAAGCGGCUCCGGCCCUUCCACCCCCCGGCAGCCCCUGGGCAACCGGCCCCUGCCCGCCAGCCU
GGCCCCCACCCCCACCGGCCCCGUGCACGAGCCCGUGGGCAGCCUGACCCCCGCCCCCGUGCCCCAGCCCCUGGACCCCGCCC
CCGCCGUGACCCCCGAGGCCAGCCACCUGCUGGAGGACCCCGACGAGGAGACCAGCCAGGCCGUGAAGGCCCUGCGGGAGAUG
GCCGACACCGUGAUCCCCCAGAAGGAGGAGGCCGCCAUCUGCGGCCAGAUGGACCUGAGCCACCCCCCCCCCCGGGGCCACCU
```

```
GGACGAGCUGACCACCACCCUGGAGAGCAUGACCGAGGACCUGAACCUGGACAGCCCCCUGACCCCCGAGCUGAACGAGAUCC

UGGACACCUUCCUGAACGACGAGUGCCUGCUGCACGCCAUGCACAUCAGCACCGGCCUGAGCAUCUUCGACACCAGCCUGUUC

AGCGGCGGCAAGCGGCCCGCCGCCACCAAGAAGGCCGGCCAGGCCAAGAAGAAGAAGGGCAGCUACCCCUACGACGUGCCCGA

CUACGCCUGAGCGGCCGCUUAAUUAAGCUGCCUUCUGCGGGGCUUGCCUUCUGGCCAUGCCCUUCUUCUCUCCCUUGCACCUG

UACCUCUUGGUCUUUGAAUAAAGCCUGAGUAGGAAGUCUAGAAAAAAAAAAAAAAAAAAAAAAAAAAAAAAAAAAAAAAAAAA

AAAAAAAAAAAAAAAAAAAAAAAAAAAAAAAAAAAA
```

>ZF8 target sequence

SEQ ID NO.: 130

```
CTTGGGGTGACAATGGCTTGG
```

>ZF8 amino acid sequence

SEQ ID NO.: 131

```
LEPGEKPYKCPECGKSFSRSDHLTTHQRTHTGEKPYKCPECGKSFSTSGELVRHQRTHTGEKPYKCPECGKSFSRRDELNVHQ

RTHTGEKPYKCPECGKSFSSPADLTRHQRTHTGEKPYKCPECGKSFSRSDELVRHQRTHTGEKPYKCPECGKSFSRSDKLVRH

QRTHTGEKPYKCPECGKSFSTTGALTEHQRTHTGEKPTGKKTS
```

>ZF8 mRNA sequence

SEQ ID NO.: 218

```
CUGGAACCGGGCGAAAAGCCGUACAAGUGCCCGGAAUGUGGCAAAAGUUUUAGUCGCAGCGAUCAUCUGACCACCCAUCAGCG

UACCCAUACCGGUGAGAAGCCAUACAAAUGCCCAGAAUGUGGUAAGAGCUUUAGCACCAGCGGCGAGCUGGUUCGUCACCAGC

GUACCCACACCGGCGAGAAGCCGUAUAAGUGUCCAGAAUGCGGUAAAAGCUUUAGCCGCCGCGACGAGCUGAAUGUGCAUCAA

CGCACCCACACGGGCGAGAAGCCAUAUAAGUGCCCGGAGUGUGGUAAGAGUUUCAGUAGCCCAGCGGAUCUGACCCGUCAUCA

ACGUACGCACACGGGCGAGAAACCAUACAAGUGUCCGGAGUGCGGCAAAAGUUUUAGCCGCAGUGAUGAACUGGUGCGCCACC

AGCGCACCCAUACCGGCGAAAAACCGUAUAAGUGCCCAGAGUGCGGUAAGAGCUUCAGCCGCAGCGACAAACUGGUGCGUCAC

CAGCGCACGCAUACGGGUGAGAAACCGUACAAGUGCCCGGAGUGCGGCAAAAGCUUCAGCACCACCGGCGCGCUGACCGAACA

UCAACGUACCCAUACGGGUGAGAAACCAACGGGCAAAAGACCAGC
```

>ZF9-VPR protein

SEQ ID NO.: 132

```
MAPKKKRKVGIHGVPAAGSSGSLEPGEKPYKCPECGKSFSQSGNLTEHQRTHTGEKPYKCPECGKSFSHKNALQNHQRTHTGE

KPYKCPECGKSFSQNSTLTEHQRTHTGEKPYKCPECGKSFSSKKHLAEHQRTHTGEKPYKCPECGKSFSTSGNLVRHQRTHTG

EKPYKCPECGKSFSQSGHLTEHQRTHTPNPHRRTDPSHKPFQYKCPECGKSFSDKKDLTRHQRTHTGEKPTGKKTSASGSGGG

SGGDALDDFDLDMLGSDALDDFDLDMLGSDALDDFDLDMLGSDALDDFDLDMLSGGPKKKRKVGSQYLPDTDDRHRIEEKRKR

TYETFKSIMKKSPFSGPTDPRPPPRRIAVPSRSSASVPKPAPQPYPFTSSLSTINYDEFPTMVFPSGQISQASALAPAPPQVL

PQAPAPAPAPAMVSALAQAPAPVPVLAPGPPQAVAPPAPKPTQAGEGTLSEALLQLQFDDEDLGALLGNSTDPAVFTDLASVD

NSEFQQLLNQGIPVAPHTTEPMLMEYPEAITRLVTGAQRPPDPAPAPLGAPGLPNGLLSGDEDFSSIADMDFSALLGSGSGSR

DSREGMFLPKPEAGSAISDVFEGREVCQPKRLRPFHPPGSPWANRPLPASLAPTPTGPVHEPVGSLTPAPVPQPLDPAPAVTP

EASHLLEDPDEETSQAVKALREMADTVIPQKEEAAICGQMDLSHPPPRGHLDELTTTLESMTEDLNLDSPLTPELNEILDTFL

NDECLLHAMHISTGLSIFDTSLFSGGKRPAATKKAGQAKKKKGSYPYDVPDYA*
```

>ZF9-VPR mRNA

SEQ ID NO.: 133

```
AGGAAAUAAGAGAGAAAGAAGAGUAAGAAGAAAUAUAAGAGCCACCAUGGCCCCCAAGAAGAAGCGGAAGGUGGGCAUCCAC

GGCGUGCCCGCCGCCGGCAGCAGCGGAUCCCUCGAACCGGGCGAAAAGCCAUACAAAUGUCCGGAGUGUGGCAAGAGUUUCAG

CCAAAGCGGCAACCUCACCGAGCACCAGCGCACGCACACCGGCGAGAAGCCAUAUAAAUGUCCAGAAUGCGGCAAGAGCUUCA

GCCAUAAGAAUGCGCUGCAGAACCAUCAGCGCACCCACACCGGUGAGAAGCCAUACAAGUGCCCAGAGUGCGGCAAAAGUUUC

AGCCAGAAUAGCACCCUCACGGAGCAUCAACGCACGCAUACGGGUGAAAAGCCGUACAAAUGCCCAGAAUGUGGCAAGAGCUU

UAGCAGCAAGAAACAUCUGGCGGAGCAUCAGCGUACCCACACGGGCGAAAAGCCAUACAAAUGUCCGGAAUGCGGCAAAAGCU

UCAGCACGAGUGGCAAUCUGGUGCGCCAUCAACGUACGCACACGGGUGAGAAACCGUAUAAAUGCCCAGAGUGUGGUAAAAGC

UUCAGUCAGAGCGGCCAUCUGACCGAACACCAGCGCACCCAUACGCCAAACCCGCAUCGCCGCACCGAUCCGAGCCACAAGCC
```

-continued

```
GUUCCAGUACAAGUGUCCAGAGUGCGGUAAAAGUUUUAGCGACAAGAAGGAUCUGACCCGUCACCAACGUACCCAUACCGGUG

AAAAACCAACGGGCAAGAAAACCAGCGCUAGCGGCAGCGGCGGCGGCAGCGGCGGCGACGCCCUGGACGACUUCGACCUGGAC

AUGCUGGGCAGCGACGCCCUGGACGACUUCGACCUGGACAUGCUGGGCAGCGACGCCCUGGACGACUUCGACCUGGACAUGCU

GGGCAGCGACGCCCUGGACGACUUCGACCUGGACAUGCUGAGCGGCGGCCCCAAGAAGAAGCGGAAGGUGGGCAGCCAGUACC

UGCCCGACACCGACGACCGGCACCGGAUCGAGGAGAAGCGGAAGCGGACCUACGAGACCUUCAAGAGCAUCAUGAAGAAAUCC

CCCUUCAGCGGCCCCACCGACCCCCGGCCCCCCCCCGGCGGAUCGCCGUGCCCAGCCGGAGCAGCGCCAGCGUGCCCAAGCC

CGCCCCCCAGCCCUACCCCUUCACCAGCAGCCUGAGCACCAUCAACUACGACGAGUUCCCCACCAUGGUGUUCCCCAGCGGCC

AGAUCAGCCAGGCCAGCGCCCUGGCCCCCGCCCCCCCCCAGGUGCUGCCCCAGGCCCCCGCCCCCGCCCCCGCCCCCGCCAUG

GUGAGCGCCCUGGCCCAGGCCCCCGCCCCCGUGCCCGUGCUGGCCCCCGGCCCCCCCCAGGCCGUGGCCCCCCCCGCCCCCAA

GCCCACCCAGGCCGGCGAGGGCACCCUGAGCGAGGCCCUGCUGCAGCUGCAGUUCGACGACGAGGACCUGGGCGCCCUGCUGG

GCAACAGCACCGACCCCGCCGUGUUCACCGACCUGGCCAGCGUGGACAACAGCGAGUUCCAGCAGCUGCUGAACCAGGGCAUC

CCCGUGGCCCCCCACACCACCGAGCCCAUGCUGAUGGAGUACCCCGAGGCCAUCACCCGGCUGGUGACCGGCGCCCAGCGGCC

CCCCGACCCCGCCCCCGCCCCCUGGGCGCCCCCGGCCUGCCCAACGGCCUGCUGAGCGGCGACGAGGACUUCAGCAGCAUCG

CCGACAUGGACUUCAGCGCCCUGCUGGGCAGCGGCAGCGGCAGCGGGACAGCCGGGAGGGCAUGUUCCUGCCCAAGCCCGAG

GCCGGCAGCGCCAUCAGCGACGUGUUCGAGGGCCGGGAGGUGUGCCAGCCCAAGCGGCUCCGGCCCUUCCACCCCCCCGGCAG

CCCCUGGGCCAACCGGCCCCUGCCCGCCAGCCUGGCCCCCACCCCCACCGGCCCCGUGCACGAGCCCGUGGGCAGCCUGACCC

CCGCCCCCGUGCCCAGCCCCUGGACCCCGCCCCCGCCGUGACCCCGAGGCCAGCCACCUGCUGGAGGACCCCGACGAGGAG

ACCAGCCAGGCCGUGAAGGCCCUGCGGGAGAUGGCCGACACCGUGAUCCCCAGAAGGAGGAGGCCGCCAUCUGCGGCCAGAU

GGACCUGAGCCACCCCCCCCCCGGGGCCACCUGGACGAGCUGACCACCACCCCUGGAGAGCAUGACCGAGGACCUGAACCUGG

ACAGCCCCCUGACCCCCGAGCUGAACGAGAUCCUGGACACCUUCCUGAACGACGAGUGCCUGCUGCACGCCAUGCACAUCAGC

ACCGGCCUGAGCAUCUUCGACACCAGCCUGUUCAGCGGCGGCAAGCGGCCCGCCGCCACCAAGAAGGCCGGCCAGGCCAAGAA

GAAGAAGGGCAGCUACCCCUACGACGUGCCCGACUACGCCUGAGCGGCCGCUUAAUUAAGCUGCCUUCUGCGGGGCUUGCCUU

CUGGCCAUGCCCUUCUUCUCUCCCUUGCACCUGUACCUCUUGGUCUUUGAAUAAAGCCUGAGUAGGAAGUCUAGAAAAAAAAA

AAAAAAAAAAAAAAAAAAAAAAAAAAAAAAAAAAAAAAAAAAAAAAAAAAAAAAAAAAAAAAAAAA
```

>ZF9 target
SEQ ID NO.: 134
ACCTCCGAGATCCCCTAATTCAA

>ZF9 amino acid sequence
SEQ ID NO.: 135
LEPGEKPYKCPECGKSFSQSGNLTEHQRTHTGEKPYKCPECGKSFSHKNALQNHQRTHTGEKPYKCPECGKSFSQNSTLTEHQ
RTHTGEKPYKCPECGKSFSSKKHLAEHQRTHTGEKPYKCPECGKSFSTSGNLVRHQRTHTGEKPYKCPECGKSFSQSGHLTEH
QRTHTPNPHRRTDPSHKPFQYKCPECGKSFSDKKDLTRHQRTHTGEKPTGKKTS >ZF9 mRNA sequnce
SEQ ID NO.: 219
```
CUCGAACCGGGCGAAAAGCCAUACAAAUGUCCGGAGUGUGGCAAGAGUUUCAGCCAAAGCGGCAACCUCACCGAGCACCAGCG CACGCACACCGGCGAGAAGCCAUAUAAAUGUCCAGAAUGCGGCAAGAGCUUCAGCCAUAAGAAUGCGCUGCAGAACCAUCAGC GCACCCACACCGGUGAGAAGCCAUACAAGUGCCCAGAGUGCGGCAAAAGUUUCAGCCAGAAUAGCACCCUCACGGAGCAUCAA CGCACGCAUACGGGUGAAAAGCCGUACAAAUGCCCAGAAUGUGGCAAGAGCUUUAGCAGCAAGAAACAUCUGGCGGAGCAUCA GCGUACCCACACGGGCGAAAAGCCAUACAAAUGUCCGGAAUGCGGCAAAAGCUUCAGCACGAGUGGCAAUCUGGUGCGCCAUC AACGUACGCACACGGGUGAGAAACCGUAUAAAUGCCCAGAGUGUGGUAAAAGCUUCAGUCAGAGCGGCCAUCUGACCGAACAC CAGCGCACCCAUACGCCAAACCCGCAUCGCCGCACCGAUCCGAGCCACAAGCCGUUCCAGUACAAGUGUCCAGAGUGCGGUAA AAGUUUUAGCGACAAGAAGGAUCUGACCCGUCACCAACGUACCCAUACCGGUGAAAAACCAACGGGCAAGAAAACCAGC
```

-continued

>ZF10-VPR protein
SEQ ID NO.: 136
MAPKKKRKVGIHGVPAAGSSGSLEPGEKPYKCPECGKSFSQNSTLTEHQRTHTGEKPYKCPECGKSFSERSHLREHQRTHTGE
KPYKCPECGKSFSSKKHLAEHQRTHTGEKPYKCPECGKSFSRNDTLTEHQRTHTGEKPYKCPECGKSFSDCRDLARHQRTHTG
EKPYKCPECGKSFSQSGDLRRHQRTHTGEKPYKCPECGKSFSTKNSLTEHQRTHTGKKTSASGSGGGSGGDALDDFDL
DMLGSDALDDFDLDMLGSDALDDFDLDMLGSDALDDFDLDMLSGGPKKKRKVGSQYLPDTDDRHRIEEKRKRTYETFKSIMKK
SPFSGPTDPRPPPRRIAVPSRSSASVPKPAPQPYPFTSSLSTINYDEFPTMVFPSGQISQASALAPAPPQVLPQAPAPAPAPA
MVSALAQAPAPVPVLAPGPPQAVAPPAPKPTQAGEGTLSEALLQLQFDDEDLGALLGNSTDPAVFTDLASVDNSEFQQLLNQG
IPVAPHTTEPMLMEYPEAITRLVTGAQRPPDPAPAPLGAPGLPNGLLSGDEDFSSIADMDFSALLGSGSGSRDSREGMFLPKP
EAGSAISDVFEGREVCQPKRLRPFHPPGSPWANRPLPASLAPTPTGPVHEPVGSLTPAPVPQPLDPAPAVTPEASHLLEDPDE
ETSQAVKALREMADTVIPQKEEAAICGQMDLSHPPPRGHLDELTTTLESMTEDLNLDSPLTPELNEILDTFLNDECLLHAMHI
STGLSIFDTSLFSGGKRPAATKKAGQAKKKKGSYPYDVPDYA*

>ZF10-VPR mRNA
SEQ ID NO.: 137
AGGAAAUAAGAGAGAAAAGAAGAGUAAGAAGAAAUAUAAGAGCCACCAUGGCCCCCAAGAAGAAGCGGAAGGUGGGCAUCCAC
GGCGUGCCCGCCGCCGGCAGCAGCGGAUCCCUGGAGCCCGGCGAGAAGCCCUACAAAUGUCCCGAGUGUGGCAAGUCCUUCUC
CCAGAAUAGCACACUGACAGAACACCAGAGGACACACACCGGCGAGAAACCUUAUAAGUGCCCCGAAUGCGGCAAAAGCUUUU
CCGAGAGGAGCCACCUGAGGGAACACCAGAGAACACACACCGGAGAAAAACCUUACAAAUGCCCCGAGUGCGGAAAGUCCUUC
AGCAGCAAGAAGCACCUGGCUGAACACCAGAGAACCCACACCGGCGAGAAGCCUUACAAGUGCCCCGAAUGUGGCAAAAGCUU
UCUCUAGAAACGACACACUCACCGAGCACCAGAGAACCCACACCGGCGAAAAGCCUUAUAAGUGUCCCGAGUGUGGCAAGAGCU
UCAGCGAUUGUAGAGAUCUGGCCAGACACCAAAGGACCCACACCGGAGAAAAACCUUACAAGUGCCCCGAGUGUGGAAAGAGC
UUUAGCCAAAGCGGCGAUCUGAGGAGACACCAGAGAACACACACCGGCGAAAAACCCUAUAAGUGUCCCGAAUGCGGAAAAUC
CUUCAGCACCAAAAACUCUCUGACCGAGCACCAAAGAACCCACACCGGCGAAAAGCCUACCGGCAAAAAGACAAGCGCUAGCG
GCAGCGGCGGCGGCAGCGGCGGCGACGCCCUGGACGACUUCGACCUGGACAUGCUGGGCAGCGACGCCCUGGACGACUUCGAC
CUGGACAUGCUGGGCAGCGACGCCCUGGACGACUUCGACCUGGACAUGCUGGGCAGCGACGCCCUGGACGACUUCGACCUGGA
CAUGCUGAGCGGCGGCCCCAAGAAGAAGCGGAAGGUGGGCAGCCAGUACCUGCCCGACACCGACGACCGGCACCGGAUCGAGG
AGAAGCGGAAGCGGACCUACGAGACCUUCAAGAGCAUCAUGAAGAAAUCCCCCUUCAGCGGCCCCACCGACCCCCGGCCCCCC
CCCCGGCGGAUCGCCGUGCCCAGCCGGAGCAGCGCCAGCGUGCCCAAGCCCGCCCCCAGCCCUACCCCUUCACCAGCAGCCU
GAGCACCAUCAACUACGACGAGUUCCCCACCAUGGUGUUCCCCAGCGGCCAGAUCAGCCAGGCCAGCGCCCUGGCCCCCGCCC
CCCCCCAGGUGCUGCCCCAGGCCCCCGCCCCGCCCCGCCCCGCCAUGGUGAGCGCCCUGGCCCAGGCCCCCGCCCCGUG
CCCGUGCUGGCCCCCGGCCCCCCCCAGGCCGUGGCCCCCCCGCCCCCAAGCCCACCCAGGCCGGCGAGGGCACCCUGAGCGA
GGCCCUGCUGCAGCUGCAGUUCGACGACGAGGACCUGGGCGCCCUGCUGGGCAACAGCACCGACCCCGCCGUGUUCACCGACC
UGGCCAGCGUGGACAACAGCGAGUUCCAGCAGCUGCUGAACCAGGGCAUCCCCGUGGCCCCCACACCACCGAGCCCAUGCUG
AUGGAGUACCCCGAGGCCAUCACCCGGCUGGUGACCGGCGCCCAGCGGCCCCCCGACCCCGCCCCCGCCCCCUGGGCGCCCC
CGGCCUGCCCAACGGCCUGCUGAGCGGCGACGAGGACUUCAGCAGCAUCGCCGACAUGGACUUCAGCGCCCUGCUGGGCAGCG
GCAGCGGCAGCCGGGACAGCCGGGAGGGCAUGUUCCUGCCCAAGCCCGAGGCCGGCAGCGCCAUCAGCGACGUGUUCGAGGGC
CGGGAGGUGUGCCAGCCCAAGCGGCUCCGGCCCUUCCACCCCCCGGCAGCCCCUGGGCCAACCGGCCCCUGCCCGCCAGCCU
GGCCCCCACCCCCACCGGCCCCGUGCACGAGCCCGUGGGCAGCCUGACCCCCGCCCCCGUGCCCAGCCCCUGGACCCCGCCC
CCGCCGUGACCCCCGAGGCCAGCCACCUGCUGGAGGACCCCGACGAGGAGACCAGCCAGGCCGUGAAGGCCCUGCGGGAGAUG
GCCGACACCGUGAUCCCCCAGAAGGAGGAGGCCGCCAUCUGCGGCCAGAUGGACCUGAGCCACCCCCCCCCCCGGGGCCACCU
GGACGAGCUGACCACCACCCUGGAGAGCAUGACCGAGGACCUGAACCUGGACAGCCCCCUGACCCCCGAGCUGAACGAGAUCC
UGGACACCUUCCUGAACGACGAGUGCCUGCUGCACGCCAUGCACAUCAGCACCGGCCUGAGCAUCUUCGACACCAGCCUGUUC

```
AGCGGCGGCAAGCGGCCCGCCGCCACCAAGAAGGCCGGCCAGGCCAAGAAGAAGAAGGGCAGCUACCCCUACGACGUGCCCGA

CUACGCCUGAGCGGCCGCUUAAUUAAGCUGCCUUCUGCGGGGCUUGCCUUCUGGCCAUGCCCUUCUUCUCUCCCUUGCACCUG

UACCUCUUGGUCUUUGAAUAAAGCCUGAGUAGGAAGUCUAGAAAAAAAAAAAAAAAAAAAAAAAAAAAAAAAAAAAAAAAAAA

AAAAAAAAAAAAAAAAAAAAAAAAAAAAAAAAAAA
```

>ZF10 target sequence

SEQ ID NO.: 138

```
CCTGCAGCCCCGCCCAGCCTA
```

>ZF10 amino acid sequence

SEQ ID NO.: 139

```
LEPGEKPYKCPECGKSFSQNSTLTEHQRTHTGEKPYKCPECGKSFSERSHLREHQRTHTGEKPYKCPECGKSFSSKKHLAEHQ

RTHTGEKPYKCPECGKSFSRNDTLTEHQRTHTGEKPYKCPECGKSFSDCRDLARHQRTHTGEKPYKCPECGKSFSQSGDLRRH

QRTHTGEKPYKCPECGKSFSTKNSLTEHQRTHTGEKPTGKKTS
```

>ZF10 mRNA sequence

SEQ ID NO.: 220

```
CUGGAGCCCGGCGAGAAGCCCUACAAAUGUCCCGAGUGUGGCAAGUCCUUCUCCCAGAAUAGCACACUGACAGAACACCAGAG

GACACACACCGGCGAGAAACCUUAUAAGUGCCCCGAAUGCGGCAAAAGCUUUUCCGAGAGGAGCCACCUGAGGGAACACCAGA

GAACACACACCGGAGAAAAACCUUACAAAUGCCCCGAGUGCGGAAAGUCCUUCAGCAGCAAGAAGCACCUGGCUGAACACCAG

AGAACCCACACCGGCGAGAAGCCUUACAAGUGCCCCGAAUGUGGCAAAAGCUUCUCUAGAAACGACACACUCACCGAGCACCA

GAGAACCCACACCGGCGAAAAGCCUUAUAAGUGUCCCGAGUGUGGCAAGAGCUUCAGCGAUUGUAGAGAUCUGGCCAGACACC

AAAGGACCCACACCGGAGAAAAACCUUACAAGUGCCCCGAGUGUGGAAAGAGCUUUAGCCAAAGCGGCGAUCUGAGGAGACAC

CAGAGAACACACACCGGCGAAAAACCCUAUAAGUGUCCCGAAUGCGGAAAAUCCUUCAGCACCAAAAACUCUCUGACCGAGCA

CCAAAGAACCCACACCGGCGAAAAGCCUACCGGCAAAAAGACAAGC
```

>ZF11-VPR protein

SEQ ID NO.: 140

```
MAPKKKRKVGIHGVPAAGSSGSLEPGEKPYKCPECGKSFSERSHLREHQRTHTGEKPYKCPECGKSFSRADNLTEHQRTHTGE

KPYKCPECGKSFSRSDKLTEHQRTHTGEKPYKCPECGKSFSSKKHLAEHQRTHTGEKPYKCPECGKSFSTKNSLTEHQRTHTG

EKPYKCPECGKSFSDKKDLTRHQRTHTGEKPYKCPECGKSFSSKKHLAEHQRTHTGEKPTGKKTSASGSGGGSGGDALDDFDL

DMLGSDALDDFDLDMLGSDALDDFDLDMLGSDALDDFDLDMLSGGPKKKRKVGSQYLPDTDDRHRIEEKRKRTYETFKSIMKK

SPFSGPTDPRPPPRRIAVPSRSSASVPKPAPQPYPFTSSLSTINYDEFPTMVFPSGQISQASALAPAPPQVLPQAPAPAPAPA

MVSALAQAPAPVPVLAPGPPQAVAPPAPKPTQAGEGTLSEALLQLQFDDEDLGALLGNSTDPAVFTDLASVDNSEFQQLLNQG

IPVAPHTTEPMLMEYPEAITRLVTGAQRPPDPAPAPLGAPGLPNGLLSGDEDFSSIADMDFSALLGSGSGSRDSREGMFLPKP

EAGSAISDVFEGREVCQPKRLRPFHPPGSPWANRPLPASLAPTPTGPVHEPVGSLTPAPVPQPLDPAPAVTPEASHLLEDPDE

ETSQAVKALREMADTVIPQKEEAAICGQMDLSHPPPRGHLDELTTTLESMTEDLNLDSPLTPELNEILDTFLNDECLLHAMHI

STGLSIFDTSLFSGGKRPAATKKAGQAKKKKGSYPYDVPDYA*
```

>ZF11-VPR mRNA

SEQ ID NO.: 141

```
AGGAAAUAAGAGAGAAAAGAAGAGUAAGAAGAAAUAUAAGAGCCACCAUGGCCCCCAAGAAGAAGCGGAAGGUGGGCAUCCAC

GGCGUGCCCGCCGCCGGCAGCAGCGGAUCCCUGGAGCCCGGCGAGAAACCCUACAAGUGUCCCGAGUGUGGCAAGAGCUUUUC

CGAGAGAAGCCACCUGAGGGAACACCAGAGAACCCACACCGGCGAGAAGCCUUACAAAUGCCCCGAAUGUGGAAAGAGCUUUU

CUAGAGCCGACAAUCUGACCGAACACCAAAGAACCCACACCGGCGAAAAACCCUAUAAGUGUCCCGAGUGUGGAAAAAGCUUC

UCUAGAAGCGACAAACUCACAGAGCACCAGAGGACACACACCGGCGAGAAGCCCUACAAAUGUCCCGAGUGCGGCAAAAGCUU

CAGCAGCAAGAAGCACCUGGCCGAGCACCAAAGAACACACACCGGCGAAAAACCUUAUAAAUGCCCCGAGUGCGGCAAGUCCU

UUUCCACCAAGAACUCUCUGACAGAACACCAAAGGACACACACCGGAGAAAAACCCUACAAAUGUCCCGAAUGUGGCAAAUCC

UUCAGCGAUAAGAAGGACCUCACCAGACACCAGAGGACACACACCGGCGAAAAACCUUUAUAAAUGUCCCGAGUGCGGAAAGUC

CUUCUCCAGCAAAAAGCACCUCGCUGAGCACCAAAGGACCCACACCGGCGAGAAGCCCACCGGAAAAAAGACCAGCGCUAGCG

GCAGCGGCGGCGGCAGCGGCGGCGACGCCCUGGACGACUUCGACCUGGACAUGCUGGGCAGCGACGCCCUGGACGACUUCGAC
```

-continued

```
CUGGACAUGCUGGGCAGCGACGCCCUGGACGACUUCGACCUGGACAUGCUGGGCAGCGACGCCCUGGACGACUUCGACCUGGA

CAUGCUGAGCGGCGGCCCCAAGAAGAAGCGGAAGGUGGGCAGCCAGUACCUGCCCGACACCGACGACCGGCACCGGAUCGAGG

AGAAGCGGAAGCGGACCUACGAGACCUUCAAGAGCAUCAUGAAGAAAUCCCCCUUCAGCGGCCCCACCGACCCCCGGCCCCCC

CCCCGGCGGAUCGCCGUGCCCAGCCGGAGCAGCGCCAGCGUGCCCAAGCCCGCCCCCAGCCCUACCCCUUCACCAGCAGCCU

GAGCACCAUCAACUACGACGAGUUCCCCACCAUGGUGUUCCCCAGCGGCCAGAUCAGCCAGGCCAGCGCCCUGGCCCCCGCCC

CCCCCAGGUGCUGCCCCAGGCCCCCGCCCCCGCCCCCGCCCCCGCCAUGGUGAGCGCCCUGGCCCAGGCCCCCGCCCCCGUG

CCCGUGCUGGCCCCCGGCCCCCCCCAGGCCGUGGCCCCCCCCGCCCCCAAGCCCACCCAGGCCGGCGAGGGCACCCUGAGCGA

GGCCCUGCUGCAGCUGCAGUUCGACGACGAGGACCUGGGCGCCCUGCUGGGCAACAGCACCGACCCCGCCGUGUUCACCGACC

UGGCCAGCGUGGACAACAGCGAGUUCCAGCAGCUGCUGAACCAGGGCAUCCCCGUGGCCCCCACACCACCGAGCCCAUGCUG

AUGGAGUACCCCGAGGCCAUCACCCGGCUGGUGACCGGCGCCCAGCGGCCCCCCGACCCCGCCCCCGCCCCCUGGGCGCCCC

CGGCCUGCCCAACGGCCUGCUGAGCGGCGACGAGGACUUCAGCAGCAUCGCCGACAUGGACUUCAGCGCCCUGCUGGGCAGCG

GCAGCGGCAGCCGGGACAGCCGGGAGGGCAUGUUCCUGCCCAAGCCCGAGGCCGGCAGCGCCAUCAGCGACGUGUUCGAGGGC

CGGGAGGUGUGCCAGCCCAAGCGGCUCCGGCCCUUCCACCCCCCCGGCAGCCCCUGGGCCAACCGGCCCCUGCCCGCCAGCCU

GGCCCCCACCCCCACCGGCCCCGUGCACGAGCCCGUGGGCAGCCUGACCCCCGCCCCCGUGCCCAGCCCCCUGGACCCCGCCC

CCGCCGUGACCCCCGAGGCCAGCCACCUGCUGGAGGACCCCGACGAGGAGACCAGCCAGGCCGUGAAGGCCCUGCGGGAGAUG

GCCGACACCGUGAUCCCCCAGAAGGAGGAGGCCGCCAUCUGCGGCCAGAUGGACCUGAGCCACCCCCCCCCCGGGGCCACCU

GGACGAGCUGACCACCACCCUGGAGAGCAUGACCGAGGACCUGAACCUGGACAGCCCCCUGACCCCCGAGCUGAACGAGAUCC

UGGACACCUUCCUGAACGACGAGUGCCUGCUGCACGCCAUGCACAUCAGCACCGGCCUGAGCAUCUUCGACACCAGCCUGUUC

AGCGGCGGCAAGCGGCCCGCCGCCACCAAGAAGGCCGGCCAGGCCAAGAAGAAGAAGGGCAGCUACCCCUACGACGUGCCCGA

CUACGCCUGAGCGGCCGCUUAAUUAAGCUGCCUUCUGCGGGGCUUGCCUUCUGGCCAUGCCCUUCUUCUCUCCCUUGCACCUG

UACCUCUUGGUCUUUGAAUAAAGCCUGAGUAGGAAGUCUAGAAAAAAAAAAAAAAAAAAAAAAAAAAAAAAAAAAAAAAAAAA

AAAAAAAAAAAAAAAAAAAAAAAAAAAAAAAAAAA
```

>ZF11 target sequence
SEQ ID NO.: 142
CCCACCCCUCCCCGGCAGAGC

>ZF11 amino acid sequence
SEQ ID NO.: 143
LEPGEKPYKCPECGKSFSERSHLREHQRTHTGEKPYKCPECGKSFSRADNLTEHQRTHTGEKPYKCPECGKSFSRSDKLTEHQ RTHTGEKPYKCPECGKSFSSKKHLAEHQRTHTGEKPYKCPECGKSFSTKNSLTEHQRTHTGEKPYKCPECGKSFSDKKDLTRH

QRTHTGEKPYKCPECGKSFSSKKHLAEHQRTHTGEKPTGKKTS

>ZF11 mRNA sequence
SEQ ID NO.: 221
CUGGAGCCCGGCGAGAAACCCUACAAGUGUCCCGAGUGUGGCAAGAGCUUUUCCGAGAGAAGCCACCUGAGGGAACACCAGAG AACCCACACCGGCGAGAAGCCUUACAAAUGCCCCGAAUGUGGAAAGAGCUUUUCUAGAGCCGACAAUCUGACCGAACACCAAA GAACCCACACCGGCGAAAAACCCUAUAAGUGUCCCGAGUGUGGAAAAAGCUUCUCUAGAAGCGACAAACUCACAGAGCACCAG AGGACACACACCGGCGAGAAGCCCUACAAAUGUCCCGAGUGCGGAAAAGCUUCAGCAGCAAGAAGCACCUGGCCGAGCACCA AAGAACACACACCGGCGAAAAACCUUAUAAAUGCCCCGAGUGCGGCAAGUCCUUUUCCACCAAGAACUCUCUGACAGAACACC AAAGGACACACACCGGAGAAAAACCCUACAAAUGUCCCGAAUGUGGCAAAUCCUUCAGCGAUAAGAAGGACCUCACCAGACAC CAGAGGACACACACCGGCGAAAAACCUUAUAAAUGUCCCGAGUGCGGAAAGUCCUUCUCCAGCAAAAAGCACCUCGCUGAGCA

CCAAAGGACCCACACCGGCGAGAAGCCCACCGGAAAAAAGACCAGC

>ZF12-VPR protein
SEQ ID NO.: 144
MAPKKKRKVGIHGVPAAGSSGSLEPGEKPYKCPECGKSFSSKKHLAEHQRTHTGEKPYKCPECGKSFSTHLDLIRHQRTHTGE KPYKCPECGKSFSRKDNLKNHQRTHTGEKPYKCPECGKSFSDCRDLARHQRTHTGEKPYKCPECGKSFSREDNLHTHQRTHTG EKPYKCPECGKSFSDPGHLVRHQRTHTGEKPYKCPECGKSFSQLAHLRAHQRTHTGEKPTGKKTSASGSGGGSGGDALDDFDL
DMLGSDALDDFDLDMLGSDALDDFDLDMLGSDALDDFDLDMLSGGPKKKRKVGSQYLPDTDDRHRIEEKRKRTYETFKSIMKK
SPFSGPTDPRPPPRRIAVPSRSSASVPKPAPQPYPFTSSLSTINYDEFPTMVFPSGQISQASALAPAPPQVLPQAPAPAPAPA
MVSALAQAPAPVPVLAPGPPQAVAPPAPKPTQAGEGTLSEALLQLQFDDEDLGALLGNSTDPAVFTDLASVDNSEFQQLLNQG
IPVAPHTTEPMLMEYPEAITRLVTGAQRPPDPAPAPLGAPGLPNGLLSGDEDFSSIADMDFSALLGSGSGSRDSREGMFLPKP
EAGSAISDVFEGREVCQPKRLRPFHPPGSPWANRPLPASLAPTPTGPVHEPVGSLTPAPVPQPLDPAPAVTPEASHLLEDPDE
ETSQAVKALREMADTVIPQKEEAAICGQMDLSHPPPRGHLDELTTTLESMTEDLNLDSPLTPELNEILDTFLNDECLLHAMHI
STGLSIFDTSLFSGGKRPAATKKAGQAKKKKGSYPYDVPDYA*

>ZF12-VPR mRNA
SEQ ID NO.: 145
AGGAAAUAAGAGAGAAAAGAAGAGUAAGAAGAAAUAUAAGAGCCACCAUGGCCCCCAAGAAGAAGCGGAAGGUGGGCAUCCAC
GGCGUGCCCGCCGCCGGCAGCAGCGGAUCCCUGGAGCCCGGCGAAAAGCCCUACAAAUGUCCCGAAUGUGGCAAGAGCUUCAG
CAGCAAAAAGCACCUGGCUGAACACCAGAGGACCCACACCGGAGAGAAACCCUAUAAAUGUCCCGAGUGUGGAAAAAGCUUCA
GCACCCACCUCGACCUCAUUAGGCACCAAAGAACCCACACCGGCGAAAAACCCUAUAAGUGUCCCGAGUGUGGAAAAUCCUUU
UCUAGAAAGGACAAUCUCAAGAAUCACCAAAGAACACACACCGGCGAGAAACCUUACAAGUGUCCCGAGUGCGGAAAGUCCUU
CUCCGACUGUAGAGAUCUGGCUAGACACCAGAGAACCCACACCGGCGAGAAGCCCUAUAAGUGCCCCGAGUGCGGCAAGUCCU
UCUCUAGAGAGGACAAUCUGCACACACACCAGAGGACCCACACCGGCGAAAAACCUUACAAAUGCCCCGAGUGUGGCAAGAGC
UUUAGCGAUCCCGGACACCUGGUGAGACACCAAAGAACCCACACCGGCGAGAAGCCUUACAAGUGUCCCGAAUGUGGAAAAUC
CUUUAGCCAGCUGGCCCACCUGAGGGCCCACCAAAGGACACACACCGGCGAAAAACCCACCGGCAAAAAGACCAGCGCUAGCG
GCAGCGGCGGCGGCAGCGGCGGCGACGCCCUGGACGACUUCGACCUGGACAUGCUGGGCAGCGACGCCCUGGACGACUUCGAC
CUGGACAUGCUGGGCAGCGACGCCCUGGACGACUUCGACCUGGACAUGCUGGGCAGCGACGCCCUGGACGACUUCGACCUGGA
CAUGCUGAGCGGCGGCCCCAAGAAGAAGCGGAAGGUGGGCAGCCAGUACCUGCCCGACACCGACGACCGGCACCGGAUCGAGG
AGAAGCGGAAGCGGACCUACGAGACCUUCAAGAGCAUCAUGAAGAAAUCCCCCUUCAGCGGCCCCACCGACCCCCGGCCCCCC
CCCCGGCGGAUCGCCGUGCCCAGCCGGAGCAGCGCCAGCGUGCCCAAGCCCGCCCCCCAGCCCUACCCCUUCACCAGCAGCCU
GAGCACCAUCAACUACGACGAGUUCCCCACCAUGGUGUUCCCCAGCGGCCAGAUCAGCCAGGCCAGCGCCCUGGCCCCCGCCC
CCCCCCAGGUGCUGCCCCAGGCCCCCGCCCCCGCCCCCGCCCCCGCCAUGGUGAGCGCCCUGGCCCAGGCCCCCGCCCCCGUG
CCCGUGCUGGCCCCCGGCCCCCCCCAGGCCGUGGCCCCCCCCGCCCCCAAGCCCACCCAGGCCGGCGAGGGCACCCUGAGCGA
GGCCCUGCUGCAGCUGCAGUUCGACGACGAGGACCUGGGCGCCCUGCUGGGCAACAGCACCGACCCCGCCGUGUUCACCGACC
UGGCCAGCGUGGACAACAGCGAGUUCCAGCAGCUGCUGAACCAGGGCAUCCCCGUGGCCCCCCACACCACCGAGCCCAUGCUG
AUGGAGUACCCCGAGGCCAUCACCCGGCUGGUGACCGGCGCCCAGCGGCCCCCCGACCCCGCCCCCGCCCCCCUGGGCGCCCC
CGGCCUGCCCAACGGCCUGCUGAGCGGCGACGAGGACUUCAGCAGCAUCGCCGACAUGGACUUCAGCGCCCUGCUGGGCAGCG
GCAGCGGCAGCCGGGACAGCCGGGAGGGCAUGUUCCUGCCCAAGCCCGAGGCCGGCAGCGCCAUCAGCGACGUGUUCGAGGGC
CGGGAGGUGUGCCAGCCCAAGCGGCUCCGGCCCUUCCACCCCCCCGGCAGCCCCUGGGCCAACCGGCCCCUGCCCGCCAGCCU
GGCCCCCACCCCCACCGGCCCCGUGCACGAGCCCGUGGGCAGCCUGACCCCCGCCCCCGUGCCCCAGCCCCUGGACCCCGCCC
CCGCCGUGACCCCCGAGGCCAGCCACCUGCUGGAGGACCCCGACGAGGAGACCAGCCAGGCCGUGAAGGCCCUGCGGGAGAUG
GCCGACACCGUGAUCCCCCAGAAGGAGGAGGCCGCCAUCUGCGGCCAGAUGGACCUGAGCCACCCCCCCCCCCGGGGCCACCU
GGACGAGCUGACCACCACCCUGGAGAGCAUGACCGAGGACCUGAACCUGGACAGCCCCCUGACCCCCGAGCUGAACGAGAUCC
UGGACACCUUCCUGAACGACGAGUGCCUGCUGCACGCCAUGCACAUCAGCACCGGCCUGAGCAUCUUCGACACCAGCCUGUUC
AGCGGCGGCAAGCGGCCCGCCGCCACCAAGAAGGCCGGCCAGGCCAAGAAGAAGAAGGGCAGCUACCCCUACGACGUGCCCGA
CUACGCCUGAGCGGCCGCUUAAUUAAGCUGCCUUCUGCGGGGCUUGCCUUCUGGCCAUGCCCUUCUUCUCUCCCUUGCACCUG
UACCUCUUGGUCUUUGAAUAAAGCCUGAGUAGGAAGUCUAGAAAAAAAAAAAAAAAAAAAAAAAAAAAAAAAAAAAAAAAAAA
AAAAAAAAAAAAAAAAAAAAAAAAAAAAAAAAA

\>ZF12 target sequence

SEQ ID NO.: 146

AGAGGCTAGGCCAAGACTCCC

\>ZF12 amino acid sequence

SEQ ID NO.: 147

LEPGEKPYKCPECGKSFSSKKHLAEHQRTHTGEKPYKCPECGKSFSTHLDLIRHQRTHTGEKPYKCPECGKSFSRKDNLKNHQ

RTHTGEKPYKCPECGKSFSDCRDLARHQRTHTGEKPYKCPECGKSFSREDNLHTHQRTHTGEKPYKCPECGKSFSDPGHLVRH

QRTHTGEKPYKCPECGKSFSQLAHLRAHQRTHTGEKPTGKKTS

\>ZF12 mRNA sequence

SEQ ID NO.: 222

CUGGAGCCCGGCGAAAAGCCCUACAAAUGUCCCGAAUGUGGCAAGAGCUUCAGCAGCAAAAAGCACCUGGCUGAACACCAGAG

GACCCACACCGGAGAGAAACCCUAUAAAUGUCCCGAGUGUGGAAAAAGCUUCAGCACCCACCUCGACCUCAUUAGGCACCAAA

GAACCCACACCGGCGAAAAACCCUAUAAGUGUCCCGAGUGUGGAAAAUCCUUUUCUAGAAAGGACAAUCUCAAGAAUCACCAA

AGAACACACACCGGCGAGAAACCUUACAAGUGUCCCGAGUGCGGAAAGUCCUUCUCCGACUGUAGAGAUCUGGCUAGACACCA

GAGAACCCACACCGGCGAGAAGCCCUAUAAGUGCCCCGAGUGCGGCAAGUCCUUCUCUAGAGAGGACAAUCUGCACACACACC

AGAGGACCCACACCGGCGAAAAACCUUACAAAUGCCCCGAGUGUGGCAAGAGCUUUAGCGAUCCCGGACACCUGGUGAGACAC

CAAAGAACCCACACCGGCGAGAAGCCUACAAGUGUCCCGAAUGUGGAAAAUCCUUUAGCCAGCUGGCCCACCUGAGGGCCCA

CCAAAGGACACACACCGGCGAAAAACCCACCGGCAAAAAGACCAGC

\>ZF13-VPR protein

SEQ ID NO.: 148

MAPKKKRKVGIHGVPAAGSSGSLEPGEKPYKCPECGKSFSRSDKLVRHQRTHTGEKPYKCPECGKSFSQSGDLRRHQRTHTGE

KPYKCPECGKSFSTSGELVRHQRTHTGEKPYKCPECGKSFSRSDKLVRHQRTHTGEKPYKCPECGKSFSDPGHLVRHQRTHTG

EKPYKCPECGKSFSRNDALTEHQRTHTGEKPYKCPECGKSFSRSDHLTNHQRTHTGEKPTGKKTSASGSGGGSGGDALDDFDL

DMLGSDALDDFDLDMLGSDALDDFDLDMLGSDALDDFDLDMLSGGPKKKRKVGSQYLPDTDDRHRIEEKRKRTYETFKSIMKK

SPFSGPTDPRPPPRRIAVPSRSSASVPKPAPQPYPFTSSLSTINYDEFPTMVFPSGQISQASALAPAPPQVLPQAPAPAPAPA

MVSALAQAPAPVPVLAPGPPQAVAPPAPKPTQAGEGTLSEALLQLQFDDEDLGALLGNSTDPAVFTDLASVDNSEFQQLLNQG

IPVAPHTTEPMLMEYPEAITRLVTGAQRPPDPAPAPLGAPGLPNGLLSGDEDFSSIADMDFSALLGSGSGSRDSREGMFLPKP

EAGSAISDVFEGREVCQPKRLRPFHPPGSPWANRPLPASLAPTPTGPVHEPVGSLTPAPVPQPLDPAPAVTPEASHLLEDPDE

ETSQAVKALREMADTVIPQKEEAAICGQMDLSHPPPRGHLDELTTTLESMTEDLNLDSPLTPELNEILDTFLNDECLLHAMHI

STGLSIFDTSLFSGGKRPAATKKAGQAKKKKGSYPYDVPDYA*

\>ZF13-VPR mRNA

SEQ ID NO.: 149

AGGAAAUAAGAGAGAAAAGAAGAGUAAGAAGAAAUAUAAGAGCCACCAUGGCCCCCAAGAAGAAGCGGAAGGUGGGCAUCCAC

GGCGUGCCCGCCGCCGGCAGCAGCGGAUCCCUGGAGCCCGGCGAAAAGCCCUAUAAGUGCCCCGAGUGCGGCAAGAGCUUCUC

UAGAAGCGACAAACUCGUGAGACACCAGAGAACACACACCGGAGAGAAACCUUACAAGUGCCCCGAGUGUGGCAAGUCCUUCU

CCCAAUCCGGCGAUCUGAGGAGACACCAGAGAACCCACACCGGCGAAAAACCCUACAAAUGCCCCGAGUGCGGAAAGUCCUUU

UCCACCUCCGGCGAGCUCGUGAGACACCAAAGGACCCACACCGGCGAGAAGCCUUACAAGUGCCCCGAGUGCGGCAAAUCCUU

CUCCAGAUCCGACAAGCUCGUGAGGCACCAGAGGACACACACCGGAGAGAAACCUUAUAAGUGUCCCGAAUGUGGAAAGUCCU

UCAGCGACCCCGGACACCUGGUGAGACACCAGAGGACCCACACCGGCGAAAAGCCUUAUAAAUGUCCCGAGUGCGGAAAAAGC

UUUUCUAGAAACGAUGCUCUGACAGAGCACCAAAGAACCCACACCGGCGAAAAACCCUACAAGUGUCCCGAGUGCGGAAAGAG

CUUCAGCAGAAGCGACCACCUGACCAACCACCAGAGAACACACACCGGAGAAAAACCCACCGGCAAAAAGACCUCCGCUAGCG

GCAGCGGCGGCAGCGGCGGCGACGCCCUGGACGACUUCGACCUGGACAUGCUGGGCAGCGACGCCCUGGACGACUUCGAC

CUGGACAUGCUGGGCAGCGACGCCCUGGACGACUUCGACCUGGACAUGCUGGGCAGCGACGCCCUGGACGACUUCGACCUGGA

CAUGCUGAGCGGCGGCCCCAAGAAGAAGCGGAAGGUGGGCAGCCAGUACCUGCCCGACACCGACGACCGGCACCGGAUCGAGG

AGAAGCGGAAGCGGACCUACGAGACCUUCAAGAGCAUCAUGAAGAAAUCCCCCUUCAGCGGCCCCACCGACCCCCGGCCCCCC

```
CCCCGGCGGAUCGCCGUGCCCAGCCGGAGCAGCGCCAGCGUGCCCAAGCCCGCCCCCAGCCCUACCCCUUCACCAGCAGCCU

GAGCACCAUCAACUACGACGAGUUCCCCACCAUGGUGUUCCCCAGCGGCCAGAUCAGCCAGGCCAGCGCCCUGGCCCCCGCCC

CCCCCAGGUGCUGCCCAGGCCCCCGCCCCCGCCCCCGCCCCCGCCAUGGUGAGCGCCCUGGCCCAGGCCCCCGCCCCCGUG

CCCGUGCUGGCCCCCGGCCCCCCCCAGGCCGUGGCCCCCCCCGCCCCCAAGCCCACCCAGGCCGGCGAGGGCACCCUGAGCGA

GGCCCUGCUGCAGCUGCAGUUCGACGACGAGGACCUGGGCGCCCUGCUGGGCAACAGCACCGACCCCGCCGUGUUCACCGACC

UGGCCAGCGUGGACAACAGCGAGUUCCAGCAGCUGCUGAACCAGGGCAUCCCCGUGGCCCCCCACACCACCGAGCCCAUGCUG

AUGGAGUACCCCGAGGCCAUCACCCGGCUGGUGACCGGCGCCCAGCGGCCCCCCGACCCCGCCCCCGCCCCCUGGGCGCCCC

CGGCCUGCCCAACGGCCUGCUGAGCGGCGACGAGGACUUCAGCAGCAUCGCCGACAUGGACUUCAGCGCCCUGCUGGGCAGCG

GCAGCGGCAGCCGGGACAGCCGGGAGGGCAUGUUCCUGCCCAAGCCCGAGGCCGGCAGCGCCAUCAGCGACGUGUUCGAGGGC

CGGGAGGUGUGCCAGCCCAAGCGGCUCCGGCCCUUCCACCCCCCGGCAGCCCUGGGCCAACCGGCCCCUGCCCGCCAGCCU

GGCCCCCACCCCCACCGGCCCCGUGCACGAGCCCGUGGGCAGCCUGACCCCCGCCCCCGUGCCCAGCCCCUGGACCCCGCCC

CCGCCGUGACCCCCGAGGCCAGCCACCUGCUGGAGGACCCCGACGAGGAGACCAGCCAGGCCGUGAAGGCCCUGCGGGAGAUG

GCCGACACCGUGAUCCCCCAGAAGGAGGAGGCCGCCAUCUGCGGCCAGAUGGACCUGAGCCACCCCCCCCCCGGGGCCACCU

GGACGAGCUGACCACCACCCUGGAGAGCAUGACCGAGGACCUGAACCUGGACAGCCCCCUGACCCCCGAGCUGAACGAGAUCC

UGGACACCUUCCUGAACGACGAGUGCCUGCUGCACGCCAUGCACAUCAGCACCGGCUGAGCAUCUUCGACACCAGCCUGUUC

AGCGGCGGCAAGCGGCCCGCCGCCACCAAGAAGGCCGGCCAGGCCAAGAAGAAGAAGGGCAGCUACCCCUACGACGUGCCCGA

CUACGCCCUGAGCGGCCGCUUAAUUAAGCUGCCUUCUGCGGGGCUUGCCUUCUGGCCAUGCCCUUCUUCUCUCCCUUGCACCUG

UACCUCUUGGUCUUUGAAUAAAGCCUGAGUAGGAAGUCUAGAAAAAAAAAAAAAAAAAAAAAAAAAAAAAAAAAAAAAAAAAA

AAAAAAAAAAAAAAAAAAAAAAAAAAAAAAAAAA
```

>ZF13 target sequence

SEQ ID NO.: 150

AGGCUGGGCGGGGCUGCAGGG

>ZF13 amino acid sequence

SEQ ID NO.: 151

LEPGEKPYKCPECGKSFSRSDKLVRHQRTHTGEKPYKCPECGKSFSQSGDLRRHQRTHTGEKPYKCPECGKSFSTSGELVRHQ

RTHTGEKPYKCPECGKSFSRSDKLVRHQRTHTGEKPYKCPECGKSFSDPGHLVRHQRTHTGEKPYKCPECGKSFSRNDALTEH

QRTHTGEKPYKCPECGKSFSRSDHLTNHQRTHTGEKPTGKKTS

>ZF13 mRNA sequence

SEQ ID NO.: 223

```
CUGGAGCCCGGCGAAAAGCCCUAUAAGUGCCCCGAGUGCGGCAAGAGCUUCUCUAGAAGCGACAAACUCGUGAGACACCAGAG

AACACACACCGGAGAGAAACCUUACAAGUGCCCCGAGUGUGGCAAGUCCUUCUCCCAAUCCGGCGAUCUGAGGAGACACCAGA

GAACCCACACCGGCGAAAAACCCUACAAAUGCCCCGAGUGCGGAAAGUCCUUUUCCACCUCCGGCGAGCUCGUGAGACACCAA

AGGACCCACACCGGCGAGAAGCCUUACAAGUGCCCCGAGUGCGGCAAAUCCUUCUCCAGAUCCGACAAGCUCGUGAGGCACCA

GAGGACACACACCGGAGAGAAACCUUAUAAGUGUCCCGAAUGUGGAAAGUCCUUCAGCGACCCCGGACACCUGGUGAGACACC

AGAGGACCCACACCGGCGAAAAGCCUUAUAAAUGUCCCGAGUGCGGAAAAAGCUUUUCUAGAAACGAUGCUCUGACAGAGCAC

CAAAGAACCCACACCGGCGAAAAACCCUACAAGUGUCCCGAGUGCGGAAAGAGCUUCAGCAGAAGCGACCACCUGACCAACCA

CCAGAGAACACACACCGGAGAAAAACCCACCGGCAAAAGACCUCC
```

>ZF14-VPR protein

SEQ ID NO.: 152

MAPKKKRKVGIHGVPAAGSSGSLEPGEKPYKCPECGKSFSTSGHLVRHQRTHTGEKPYKCPECGKSFSTTGNLTVHQRTHTGE

KPYKCPECGKSFSTSGSLVRHQRTHTGEKPYKCPECGKSFSRSDKLVRHQRTHTGEKPYKCPECGKSFSRSDELVRHQRTHTG

EKPYKCPECGKSFSRSDKLVRHQRTHTGEKPYKCPECGKSFSQRAHLERHQRTHTGEKPTGKKTSASGSGGGSGGDALDDFDL

DMLGSDALDDFDLDMLGSDALDDFDLDMLGSDALDDFDLDMLSGGPKKKRKVGSQYLPDTDDRHRIEEKRKRTYETFKSIMKK

SPFSGPTDPRPPPRRIAVPSRSSASVPKPAPQPYPFTSSLSTINYDEFPTMVFPSGQISQASALAPAPPQVLPQAPAPAPAPA

MVSALAQAPAPVPVLAPGPPQAVAPPAPKPTQAGEGTLSEALLQLQFDDEDLGALLGNSTDPAVFTDLASVDNSEFQQLLNQG

-continued

IPVAPHTTEPMLMEYPEAITRLVTGAQRPPDPAPAPLGAPGLPNGLLSGDEDFSSIADMDFSALLGSGSGSRDSREGMFLPKP

EAGSAISDVFEGREVCQPKRLRPFHPPGSPWANRPLPASLAPTPTGPVHEPVGSLTPAPVPQPLDPAPAVTPEASHLLEDPDE

ETSQAVKALREMADTVIPQKEEAAICGQMDLSHPPPRGHLDELTTTLESMTEDLNLDSPLTPELNEILDTFLNDECLLHAMHI

STGLSIFDTSLFSGGKRPAATKKAGQAKKKKGSYPYDVPDYA*

>ZF14-VPR mRNA

SEQ ID NO.: 153

AGGAAAUAAGAGAGAAAAGAAGAGUAAGAAGAAAUAUAAGAGCCACCAUGGCCCCCAAGAAGAAGCGGAAGGUGGGCAUCCAC

GGCGUGCCCGCCGCCGGCAGCAGCGGAUCCCUGGAGCCCGGCGAAAAGCCCUACAAAUGUCCCGAAUGCGGCAAAUCCUUCUC

CACCUCCGGCCACCUCGUGAGACACCAGAGGACACACACCGGCGAGAAGCCUUAUAAGUGCCCCGAAUGCGGCAAAAGCUUCU

CCACCACCGGCAAUCUGACCGUCCACCAGAGAACACACACCGGCGAAAAACCUUAUAAGUGUCCCGAGUGUGGCAAAUCCUUU

UCCACCAGCGGAUCUCUGGUGAGACACCAAAGGACACACACCGGCGAAAAACCCUACAAAUGCCCCGAGUGUGGAAAAUCCUU

CUCUAGAAGCGACAAGCUGGUGAGACACCAGAGGACCCACACCGGCGAGAAACCCUACAAGUGCCCCGAAUGUGGCAAGAGCU

UCUCUAGAUCCGACGAGCUCGUGAGACACCAAAGAACCCACACCGGCGAAAAGCCUUACAAAUGUCCCGAGUGCGGAAAGAGC

UUUAGCAGAAGCGAUAAGCUGGUCAGACACCAAAGAACACACACCGGAGAAAAACCCUAUAAGUGCCCCGAGUGUGGCAAGUC

CUUUAGCCAGAGAGCCCACCUGGAGAGACACCAAAGAACCCACACCGGCGAAAAACCCACCGGAAAAAAGACAAGCGCUAGCG

GCAGCGGCGGCGGCAGCGGCGGCGACGCCCUGGACGACUUCGACCUGGACAUGCUGGGCAGCGACGCCCUGGACGACUUCGAC

CUGGACAUGCUGGGCAGCGACGCCCUGGACGACUUCGACCUGGACAUGCUGGGCAGCGACGCCCUGGACGACUUCGACCUGGA

CAUGCUGAGCGGCGGCCCCAAGAAGAAGCGGAAGGUGGGCAGCCAGUACCUGCCCGACACCGACGACCGGCACCGGAUCGAGG

AGAAGCGGAAGCGGACCUACGAGACCUUCAAGAGCAUCAUGAAGAAAUCCCCCUUCAGCGGCCCCACCGACCCCCGGCCCCCC

CCCCGGCGGAUCGCCGUGCCCAGCCGGAGCAGCGCCAGCGUGCCCAAGCCCGCCCCCCAGCCCUACCCCUUCACCAGCAGCCU

GAGCACCAUCAACUACGACGAGUUCCCCACCAUGGUGUUCCCCAGCGGCCAGAUCAGCCAGGCCAGCGCCCUGGCCCCCGCCC

CCCCCCAGGUGCUGCCCCAGGCCCCCGCCCCCGCCCCCGCCCCCGCCAUGGUGAGCGCCCUGGCCCAGGCCCCCGCCCCCGUG

CCCGUGCUGGCCCCCGGCCCCCCCCAGGCCGUGGCCCCCCCCGCCCCCAAGCCCACCCAGGCCGGCGAGGGCACCCUGAGCGA

GGCCCUGCUGCAGCUGCAGUUCGACGACGAGGACCUGGGCGCCCUGCUGGGCAACAGCACCGACCCCGCCGUGUUCACCGACC

UGGCCAGCGUGGACAACAGCGAGUUCCAGCAGCUGCUGAACCAGGGCAUCCCCGUGGCCCCCCACACCACCGAGCCCAUGCUG

AUGGAGUACCCCGAGGCCAUCACCCGGCUGGUGACCGGCGCCCAGCGGCCCCCCGACCCCGCCCCCGCCCCCCUGGGCGCCCC

CGGCCUGCCCAACGGCCUGCUGAGCGGCGACGAGGACUUCAGCAGCAUCGCCGACAUGGACUUCAGCGCCCUGCUGGGCAGCG

GCAGCGGCAGCCGGGACAGCCGGGAGGGCAUGUUCCUGCCCAAGCCCGAGGCCGGCAGCGCCAUCAGCGACGUGUUCGAGGGC

CGGGAGGUGUGCCAGCCCAAGCGGCUCCGGCCCUUCCACCCCCCCGGCAGCCCCUGGGCCAACCGGCCCCUGCCCGCCAGCCU

GGCCCCCACCCCCACCGGCCCCGUGCACGAGCCCGUGGGCAGCCUGACCCCCGCCCCCGUGCCCCAGCCCCUGGACCCCGCCC

CCGCCGUGACCCCCGAGGCCAGCCACCUGCUGGAGGACCCCGACGAGGAGACCAGCCAGGCCGUGAAGGCCCUGCGGGAGAUG

GCCGACACCGUGAUCCCCCAGAAGGAGGAGGCCGCCAUCUGCGGCCAGAUGGACCUGAGCCACCCCCCCCCCCGGGGCCACCU

GGACGAGCUGACACCACCCUGGAGAGCAUGACCGAGGACCUGAACCUGGACAGCCCCCUGACCCCCGAGCUGAACGAGAUCC

UGGACACCUUCCUGAACGACGAGUGCCUGCUGCACGCCAUGCACAUCAGCACCGGCCUGAGCAUCUUCGACACCAGCCUGUUC

AGCGGCGGCAAGCGGCCCGCCGCCACCAAGAAGGCCGGCCAGGCCAAGAAGAAGAAGGGCAGCUACCCCUACGACGUGCCCGA

CUACGCCUGAGCGGCCGCUUAAUUAAGCUGCCUUCUGCGGGGCUUGCCUUCUGGCCAUGCCCUUCUUCUCUCCCUUGCACCUG

UACCUCUUGGUCUUUGAAUAAAGCCUGAGUAGGAAGUCUAGAAAAAAAAAAAAAAAAAAAAAAAAAAAAAAAAAAAAAAAAAA

AAAAAAAAAAAAAAAAAAAAAAAAAAAAAAAA

-continued

>ZF14 target sequence
SEQ ID NO.: 154
GGAGGGGTGGGGGTTAATGGT

>ZF14 amino acid sequence
SEQ ID NO.: 155
LEPGEKPYKCPECGKSFSTSGHLVRHQRTHTGEKPYKCPECGKSFSTTGNLTVHQRTHTGEKPYKCPECGKSFSTSGSLVRHQ
RTHTGEKPYKCPECGKSFSRSDKLVRHQRTHTGEKPYKCPECGKSFSRSDELVRHQRTHTGEKPYKCPECGKSFSRSDKLVRH
QRTHTGEKPYKCPECGKSFSQRAHLERHQRTHTGEKPTGKKTS >ZF14 mRNA sequence
SEQ ID NO.: 224
CUGGAGCCCGGCGAAAAGCCCUACAAAUGUCCCGAAUGCGGCAAAUCCUUCUCCACCUCCGGCCACCUCGUGAGACACCAGAG
GACACACACCGGCGAGAAGCCUUAUAAGUGCCCCGAAUGCGGCAAAAGCUUCUCCACCACCGGCAAUCUGACCGUCCACCAGA
GAACACACACCGGCGAAAAACCUUAUAAGUGUCCCGAGUGUGGCAAAUCCUUUUCCACCAGCGGAUCUCUGGUGAGACACCAA
AGGACACACACCGGCGAAAAACCCUACAAAUGCCCCGAGUGUGGAAAAUCCUUCUCUAGAAGCGACAAGCUGGUGAGACACCA
GAGGACCCACACCGGCGAGAAACCCUACAAGUGCCCCGAAUGUGGCAAGAGCUUCUCUAGAUCCGACGAGCUCGUGAGACACC
AAAGAACCCACACCGGCGAAAAGCCUUACAAAUGUCCCGAGUGCGGAAAGAGCUUUAGCAGAAGCGAUAAGCUGGUCAGACAC
CAAAGAACACACACCGGAGAAAAACCCUAUAAGUGCCCCGAGUGUGGCAAGUCCUUUAGCCAGAGAGCCCACCUGGAGAGACA
CCAAAGAACCCACACCGGCGAAAAACCCACCGGAAAAAGACAAGC >ZF15-VPR protein
SEQ ID NO.: 156
MAPKKKRKVGIHGVPAAGSSGSLEPGEKPYKCPECGKSFSRNDTLTEHQRTHTGEKPYKCPECGKSFSRNDALTEHQRTHTGE
KPYKCPECGKSFSTSGELVRHQRTHTGEKPYKCPECGKSFSRSDNLVRHQRTHTGEKPYKCPECGKSFSRSDELVRHQRTHTG
EKPYKCPECGKSFSRSDKLVRHQRTHTGEKPYKCPECGKSFSQSSNLVRHQRTHTGEKPTGKKTSASGSGGGSGGDALDDFDL
DMLGSDALDDFDLDMLGSDALDDFDLDMLGSDALDDFDLDMLSGGPKKKRKVGSQYLPDTDDRHRIEEKRKRTYETFKSIMKK
SPFSGPTDPRPPPRRIAVPSRSSASVPKPAPQPYPFTSSLSTINYDEFPTMVFPSGQISQASALAPAPPQVLPQAPAPAPAPA
MVSALAQAPAPVPVLAPGPPQAVAPPAPKPTQAGEGTLSEALLQLQFDDEDLGALLGNSTDPAVFTDLASVDNSEFQQLLNQG
IPVAPHTTEPMLMEYPEAITRLVTGAQRPPDPAPAPLGAPGLPNGLLSGDEDFSSIADMDFSALLGSGSGSRDSREGMFLPKP
EAGSAISDVFEGREVCQPKRLRPFHPPGSPWANRPLPASLAPTPTGPVHEPVGSLTPAPVPQPLDPAPAVTPEASHLLEDPDE
ETSQAVKALREMADTVIPQKEEAAICGQMDLSHPPPRGHLDELTTTLESMTEDLNLDSPLTPELNEILDTFLNDECLLHAMHI
STGLSIFDTSLFSGGKRPAATKKAGQAKKKKGSYPYDVPDYA*

>ZF15-VPR mRNA
SEQ ID NO.: 157
AGGAAAUAAGAGAGAAAAGAAGAGUAAGAAGAAAUAUAAGAGCCACCAUGGCCCCCAAGAAGAAGCGGAAGGUGGGCAUCCAC
GGCGUGCCCGCCGCCGGCAGCAGCGGAUCCCUGGAGCCCGGCGAGAAGCCCUACAAAUGUCCCGAAUGUGGCAAGAGCUUCUC
UAGAAACGACACACUGACCGAACACCAGAGAACACACACCGGCGAAAAACCUUAUAAAUGUCCCGAGUGUGGAAAAUCCUUCU
CUAGAAAUGACGCUCUCACCGAGCACCAAAGAACACACACCGGCGAAAAGCCUUACAAAUGCCCCGAAUGUGGAAAGUCCUUC
UCCACCUCCGGAGAGCUGGUGAGACACCAGAGAACCCACACCGGCGAAAAACCCUACAAGUGCCCCGAGUGCGGAAAAAGCUU
CUCUAGAAGCGAUAAUCUGGUGAGACACCAAAGGACACACACCGGCGAGAAGCCCUAUAAGUGUCCCGAAUGCGGCAAGUCCU
UUUCCAGAAGCGACGAACUGGUGAGACACCAGAGAACCCACACCGGAGAGAAGCCUUAUAAGUGUCCCGAGUGCGGAAAGAGC
UUUUCUAGAUCCGACAAGCUCGUGAGACACCAAAGGACCCACACCGGCGAGAAACCCUAUAAAUGUCCCGAGUGUGGCAAAUC
CUUUUCCCAGAGCAGCAACCUCGUGAGGCACCAGAGGACCCACACCGGCGAGAAACCCACCGGCAAAAAGACCAGCGCUAGCG
GCAGCGGCGGCGGCAGCGGCGGCGACGCCCUGGACGACUUCGACCUGGACAUGCUGGGCAGCGACGCCCUGGACGACUUCGAC
CUGGACAUGCUGGGCAGCGACGCCCUGGACGACUUCGACCUGGACAUGCUGGGCAGCGACGCCCUGGACGACUUCGACCUGGA
CAUGCUGAGCGGCGGCCCCAAGAAGAAGCGGAAGGUGGGCAGCCAGUACCUGCCCGACACCGACGACCGGCACCGGAUCGAGG
AGAAGCGGAAGCGGACCUACGAGACCUUCAAGAGCAUCAUGAAGAAAUCCCCCUUCAGCGGCCCCACCGACCCCCGGCCCCCC

-continued

```
CCCCGGCGGAUCGCCGUGCCCAGCCGGAGCAGCGCCAGCGUGCCCAAGCCCGCCCCCAGCCCUACCCCUUCACCAGCAGCCU
GAGCACCAUCAACUACGACGAGUUCCCCACCAUGGUGUUCCCCAGCGGCCAGAUCAGCCAGGCCAGCGCCCUGGCCCCCGCCC
CCCCCCAGGUGCUGCCCAGGCCCCCGCCCCCGCCCCCGCCCCCGCCAUGGUGAGCGCCCUGGCCCAGGCCCCCGCCCCCGUG
CCCGUGCUGGCCCCCGGCCCCCCCCAGGCCGUGGCCCCCCCCGCCCCCAAGCCCACCCAGGCCGGCGAGGGCACCCUGAGCGA
GGCCCUGCUGCAGCUGCAGUUCGACGACGAGGACCUGGGCGCCCUGCUGGGCAACAGCACCGACCCCGCCGUGUUCACCGACC
UGGCCAGCGUGGACAACAGCGAGUUCCAGCAGCUGCUGAACCAGGGCAUCCCCGUGGCCCCCCACACCACCGAGCCCAUGCUG
AUGGAGUACCCCGAGGCCAUCACCGGCUGGUGACCGGCGCCCAGCGGCCCCCCGACCCCGCCCCCGCCCCCUGGGCGCCCC
CGGCCUGCCCAACGGCCUGCUGAGCGGCGACGAGGACUUCAGCAGCAUCGCCGACAUGGACUUCAGCGCCCUGCUGGGCAGCG
GCAGCGGCAGCCGGGACAGCCGGGAGGGCAUGUUCCUGCCCAAGCCCGAGGCCGGCAGCGCCAUCAGCGACGUGUUCGAGGGC
CGGGAGGUGUGCCAGCCCAAGCGGCUCCGGCCCUUCCACCCCCCCGGCAGCCCCUGGGCCAACCGGCCCCUGCCCGCCAGCCU
GGCCCCCACCCCCACCGGCCCCGUGCACGAGCCCGUGGGCAGCCUGACCCCCGCCCCCGUGCCCAGCCCCUGGACCCCGCCC
CCGCCGUGACCCCCGAGGCCAGCCACCUGCUGGAGGACCCCGACGAGGAGACCAGCCAGGCCGUGAAGGCCCUGCGGGAGAUG
GCCGACACCGUGAUCCCCCAGAAGGAGGAGGCCGCCAUCUGCGGCCAGAUGGACCUGAGCCACCCCCCCCCCCGGGGCCACCU
GGACGAGCUGACCACCACCCUGGAGAGCAUGACCGAGGACCUGAACCUGGACAGCCCCCUGACCCCCGAGCUGAACGAGAUCC
UGGACACCUUCCUGAACGACGAGUGCCUGCUGCACGCCAUGCACAUCAGCACCGGCCUGAGCAUCUUCGACACCAGCCUGUUC
AGCGGCGGCAAGCGGCCCGCCGCCACCAAGAAGGCCGGCCAGGCCAAGAAGAAGAAGGGCAGCUACCCCUACGACGUGCCCGA
CUACGCCCUGAGCGGCCGCUUAAUUAAGCUGCCUUCUGCGGGGCUUGCCUUCUGGCCAUGCCCUUCUUCUCUCCCUUGCACCUG
UACCUCUUGGUCUUUGAAUAAAGCCUGAGUAGGAAGUCUAGAAAAAAAAAAAAAAAAAAAAAAAAAAAAAAAAAAAAAAAAA
AAAAAAAAAAAAAAAAAAAAAAAAAAAAAAAAAAAAA
```

>ZF15 target sequence
SEQ ID NO.: 158
GAAGGGGTGGAGGCTCTGCCG

>ZF15 amino acid sequence
SEQ ID NO.: 159
LEPGEKPYKCPECGKSFSRNDTLTEHQRTHTGEKPYKCPECGKSFSRNDALTEHQRTHTGEKPYKCPECGKSFSTSGELVRHQ
RTHTGEKPYKCPECGKSFSRSDNLVRHQRTHTGEKPYKCPECGKSFSRSDELVRHQRTHTGEKPYKCPECGKSFSRSDKLVRH
QRTHTGEKPYKCPECGKSFSQSSNLVRHQRTHTGEKPTGKKTS >ZF15 mRNA sequence
SEQ ID NO.: 225
```
CUGGAGCCCGGCGAGAAGCCCUACAAAUGUCCCGAAUGUGGCAAGAGCUUCUCUAGAAACGACACACUGACCGAACACCAGAG
AACACACACCGGCGAAAAACCUUAUAAAUGUCCCGAGUGUGGAAAAUCCUUCUCUAGAAAUGACGCUCUCACCGAGCACCAAA
GAACACACACCGGCGAAAAAGCCUUACAAAUGCCCCGAAUGUGGAAAGUCCUUCUCCACCUCCGGAGAGCUGGUGAGACACCAG
AGAACCCACACCGGCGAAAAACCCUACAAGUGCCCCGAGUGCGGAAAAAGCUUCUCUAGAAGCGAUAAUCUGGUGAGACACCA
AAGGACACACACCGGCGAGAAGCCCUAUAAGUGUCCCGAAUGCGGCAAGUCCUUUUCCAGAAGCGACGAACUGGUGAGACACC
AGAGAACCCACACCGGAGAGAAGCCUUAUAAGUGUCCCGAGUGCGGAAAGAGCUUUUCUAGAUCCGACAAGCUCGUGAGACAC
CAAAGGACCCACACCGGCGAGAAACCCUAUAAAUGUCCCGAGUGUGGCAAAUCCUUUUCCCAGAGCAGCAACCUCGUGAGGCA
CCAGAGGACCCACACCGGCGAGAAACCCACCGGCAAAAAGACCAGC
```

>ZF5.1-VPR mRNA (ZF5-VPR ATUM Opt_1)
SEQ ID NO.: 160
```
AGGAAAUAAGAGAGAAAAGAAGAGUAAGAAGAAAUAUAAGAGCCACCAUGGCCCCGAAGAAAAAGCGCAAAGUCGGAAUCCAU
GGUGUCCCUGCGGCUGGAAGUUCCGGCUCCUUGGAACCGGGAGAGAAGCCUUAUAAGUGUCCGGAGUGUGGGAAGUCGUUCUC
CACCUCGGGCAACCUCACCGAACAUCAGCGCACACAUACGGGGAGAAACCUUACAAAUGCCCGGAAUGUGGAAAGAGCUUCU
CCGAUUCGGGAAAUCUCAGAGUGCACCAACGCACCCACACAGGAGAAAACCGUAUAAGUGCCCCGAAUGCGGGAAAUCGUUC
UCCCACAAGAAUGCGCUGCAGAACCACCAGAGGACACAUACUGGGGAGAAGCCCUACAAGUGUCCUGAAUGCGGAAAGUCCUU
CUCGCGCAACGAUACUUUGACCGAGCACCAGCGCACUCACACCGGCGAAAAGCCGUACAAGUGCCCAGAGUGCGGUAAAAGCU
```

-continued

```
UCUCGCAACGGGCCCAUCUGGAACGGCACCAGCGGACUCACACUGGAGAAAAGCCCUACAAGUGUCCCGAGUGCGGGAAGUCC

UUUUCCCGGUCCGAUAAGCUCGUGCGCCACCAGAGAACCCAUACUGGAGAGAAACCGUACAAAUGUCCAGAAUGCGGCAAAUC

CUUCUCGGACCCGGGACACCUCGUGCGGCAUCAACGGACCCAUACCGGGGAAAAGCCCACCGGAAAGAAAACUAGCGCGUCAG

GCUCUGGUGGAGGAUCGGGGGGAGAUGCUCUGGACGACUUUGACCUUGACAUGCUUGGCUCCGACGCCCUUGACGACUUCGAC

CUCGAUAUGCUGGGAUCGGACGCCCUGGAUGACUUCGAUCUGGACAUGUUGGGCUCGGACGCGCUAGACGAUUUUGACCUGGA

UAUGCUGUCCGGAGGUCCCAAGAAGAAGCGGAAGGUCGGCAGCCAGUAUCUGCCGGAUACUGAUGACCGGCACAGAAUCGAGG

AGAAGCGAAAGCGGACCUACGAAACUUUCAAGAGCAUUAUGAAGAAGUCCCCGUUCUCGGGUCCAACCGACCCCAGACCUCCU

CCGCGGAGAAUUGCCGUGCAAGCCGCUCAAGCGCCAGCGUGCCCAAGCCAGCACCACAGCCCUACCCGUUCACCUCCUCCCU

UUCGACCAUCAACUACGACGAAUUCCCAACCAUGGUGUUCCCUAGCGGACAAAUCAGCCAGGCUUCCGCUCUGGCACCAGCCC

CACCUCAAGUGCUCCCGCAAGCGCCUGCUCCAGCACCGGCUCCUGCCAUGGUUUCAGCGCUGGCCCAAGCACCCGCUCCUGUG

CCUGUGCUGGCCCCUGGACCACCACAAGCAGUAGCCCCGCCUGCACCUAAGCCAACUCAGGCCGGCGAAGGAACCCUGAGCGA

AGCGUUGCUGCAGCUUCAGUUCGACGACGAGGACCUGGGUGCCCUGUUGGGCAACUCAACUGACCCUGCCGUGUUCACCGACC

UGGCAUCCGUCGAUAACUCCGAGUUCCAGCAGUUGCUGAACCAGGGAAUCCCAGUCGCCCCCCAUACCACCGAACCGAUGCUC

AUGGAGUACCCCGAAGCCAUCACCAGACUGGUCACCGGCGCACAAAGGCCCCCUGAUCCUGCUCCCGCACCUCUCGGUGCCCC

UGGACUGCCAAACGGCCUUCUGUCCGGCGACGAGGACUUCUCGUCCAUCGCCGAUAUGGAUUUCUCCGCCCUGCUCGGAUCCG

GCAGCGGAUCACGCGACUCGCGCGAAGGGAUGUUCCUGCCGAAGCCUGAGGCUGGUUCCGCCAUUAGCGACGUGUUCGAGGGG

CGCGAAGUCUGCCAACCCAAGAGACUGCGCCCGUUUCAUCCCCCGGGAAGCCCUUGGGCCAACAGACCUCUGCCAGCCUCCCU

GGCACCCACUCCGACUGGGCCUGUGCACGAACCCGUGGGCUCCCUGACUCCGGCACCAGUGCCACAGCCCCUGGAUCCAGCCC

CUGCUGUGACCCCGGAGGCCUCACACCUUCUGGAAGAUCCGGACGAGGAAACGUCCCAGGCCGUGAAGGCCCUGCGGGAGAUG

GCGGACACUGUGAUCCCUCAGAAAGAAGAGGCGGCCAUUUGCGGCCAGAUGGACCUCUCCCAUCCGCCUCCGAGAGGACACCU

GGAUGAACUCACGACCACCCUCGAGUCCAUGACCGAGGACCUGAACCUGGACUCCCCCCUGACACCCGAACUCAACGAGAUCC

UGGACACCUUCCUGAACGACGAGUGCCUGCUCCACGCCAUGCACAUCUCAACCGGGCUGUCGAUCUUCGACACUAGCUUGUUC

UCUGGAGGAAAGAGGCCGGCCGCUACUAAGAAGGCCGGACAAGCGAAGAAGAAGAAGGGAUCGUACCCUUACGACGUGCCCGA

CUACGCAUGAGCGGCCGCUUAAUUAAGCUGCCUUCUGCGGGGCUUGCCUUCUGGCCAUGCCCUUCUUCUCUCCCUUGCACCUG

UACCUCUUGGUCUUUGAAUAAAGCCUGAGUAGGAAGUCUAGAAAAAAAAAAAAAAAAAAAAAAAAAAAAAAAAAAAAAAAAAA

AAAAAAAAAAAAAAAAAAAAAAAAAAAAAAAAAAAAAAAAAAAAAAAAAAAAAAAAAA
```

>ZF5.1 mRNA sequence

SEQ ID NO.: 226

```
UUGGAACCGGGAGAGAAGCCUUAUAAGUGUCCGGAGUGUGGGAAGUCGUUCUCCACCUCGGGCAACCUCACCGAACAUCAGCG

CACACAUACGGGGGAGAAACCUUACAAAUGCCCGGAAUGUGGAAAGAGCUUCUCCGAUUCGGGAAAUCUCAGAGUGCACCAAC

GCACCCACACAGGAGAAAAACCGUAUAAGUGCCCCGAAUGCGGGAAAUCGUUCUCCCACAAGAAUGCGCUGCAGAACCACCAG

AGGACACAUACUGGGGAGAAGCCCUACAAGUGUCCUGAAUGCGGAAAGUCCUUCUCGCGCAACGAUACUUUGACCGAGCACCA

GCGCACUCACACCGGCGAAAAGCCGUACAAGUGCCCAGAGUGCGGUAAAAGCUUCUCGCAACGGGCCCAUCUGGAACGGCACC

AGCGGACUCACACUGGAGAAAAGCCCUACAAGUGUCCCGAGUGCGGGAAGUCCUUUUCCCGGUCCGAUAAGCUCGUGCGCCAC

CAGAGAACCCAUACUGGAGAGAAACCGUACAAAUGUCCAGAAUGCGGCAAAUCCUUCUCGGACCCGGGACACCUCGUGCGGCA

UCAACGGACCCAUACCGGGGAAAAGCCCACCGGAAAGAAAACUAGC
```

>ZF5.2-VPR mRNA (ZF5-VPR ATUM Opt_2)

SEQ ID NO. 161

```
AGGAAAUAAGAGAGAAAAGAAGAGUAAGAAGAAAUAUAAGAGCCACCAUGGCCCCGAAGAAGAAGCGGAAGGUCGGCAUCCAC

GGAGUGCCGGCAGCAGGGUCAUCAGGCUCCCUCGAACCCGGGGAAAAGCCGUACAAGUGUCCGGAGUGUGGGAAGUCAUUCUC

CACUUCCGGGAAUCUGACCGAGCAUCAACGCACCCACACUGGCGAGAAGCCCUACAAAUGCCCGGAGUGCGGAAAAUCGUUCU

CGGACUCCGGGAACCUUCGGGUCCACCAAAGGACUCAUACCGGGGAGAAACCGUACAAAUGUCCCGAAUGCGGGAAGUCGUUC
```

-continued

AGCCAUAAGAACGCGCUGCAGAACCAUCAGAGGACCCAUACUGGAGAAAAGCCCUAUAAGUGUCCGGAAUGCGGAAAGUCGUU

CUCACGCAACGACACCCUCACCGAACACCAGCGCACUCACACCGGAGAGAAGCCUUACAAGUGCCCGGAAUGUGGAAAGAGCU

UCAGCCAGCGGGCACAUCUGGAAAGACACCAGCGAACCCACACCGGGGAAAAACCGUAUAAGUGCCCCGAGUGUGGAAAGUCC

UUUUCACGGUCCGAUAAGCUCGUGCGCCACCAGAGAACUCACACUGGGGAGAAGCCGUACAAGUGUCCCGAGUGCGGCAAGAG

CUUCUCAGAUCCGGGACACCUUGUGCGACAUCAACGGACCCAUACCGGAGAAAAACCGACCGGGAAAAAGACCUCAGCAUCAG

GCUCAGGAGGCGGAUCAGGAGGCGACGCGCUCGAUGACUUCGAUCUGGACAUGUUGGGGUCCGACGCGCUUGACGACUUCGAC

CUUGAUAUGCUCGGAUCCGACGCCCUCGACGAUUUUGAUCUCGACAUGCUUGGGUCAGACGCCCUGGACGAUUUCGACCUGGA

CAUGCUGUCCGGUGGACCGAAAAAGAAGAGGAAGGUCGGGUCCCAGUACCUCCCGGACACCGAUGACCGACACCGGAUUGAAG

AGAAGCGCAAGAGAACCUACGAAACCUUCAAGUCGAUUAUGAAGAAGUCGCCGUUCUCGGGACCGACUGAUCCCAGACCGCCG

CCCAGAAGGAUUGCCGUGCCGUCGAGGUCAAGCGCCUCAGUGCCGAAACCCGCUCCGCAACCGUACCCCUUCACCUCAUCACU

UUCCACCAUCAACUACGAUGAGUUCCCCACCAUGGUGUUCCCGUCCGGCCAGAUCUCACAGGCCUCAGCCCUUGCACCGGCAC

CGCCCCAAGUCCUUCCGCAAGCACCCGCACCCGCUCCCGCUCCGGCAAUGGUGUCCGCGCUCGCACAAGCACCGGCUCCGGUG

CCGGUCUUGGCUCCGGGACCGCCGCAAGCAGUGGCACCACCCGCUCCGAAACCGACUCAGGCUGGGGAGGGAACCCUGUCCGA

AGCCCUGCUGCAACUUCAAUUCGACGAUGAAGAUCUGGGCGCACUGUUGGGAAACUCCACUGAUCCGGCAGUGUUCACCGAUC

UGGCCUCGGUGGACAACUCCGAGUUCCAGCAGCUGCUCAACCAAGGGAUUCCGGUCGCCCCGCAUACUACCGAGCCCAUGCUG

AUGGAAUACCCGGAAGCAAUCACCCGGCUGGUCACUGGUGCACAAAGACCCCCCGAUCCUGCUCCGGCACCGUUGGGAGCACC

GGGGUUGCCCAAUGGGCUGCUUUCGGGGGACGAGGAUUUUCUCGUCAAUUGCCGACAUGGACUUCUCGGCCCUGUUGGGAUCCG

GAAGCGGAAGCAGGGACUCACGAGAGGGAAUGUUCCUACCGAAGCCCGAAGCGGGAUCAGCAAUCUCAGACGUGUUUGAAGGC

CGCGAAGUCUGCCAGCCGAAGCGCCUUCGCCCGUUCCAUCCGCCGGGAUCACCCUGGGCCAACAGACCCCUGCCGGCAUCACU

GGCCCCGACUCCGACUGGUCCGGUGCACGAACCGGUCGGGAGCCUGACUCCGGCACCCGUGCCCAACCGUUGGAUCCGGCAC

CGGCAGUGACUCCGGAAGCUUCCCACCUCCUGGAGGAUCCGGACGAAGAGACUUCGCAGGCAGUGAAGGCCCUGCGCGAAAUG

GCGGACACCGUGAUUCCCCAGAAGGAAGAGGCAGCGAUCUGCGGGCAGAUGGACCUGUCACAUCCGCCCCCGAGAGGACACCU

GGACGAGCUGACCACUACCCUGGAAUCGAUGACUGAAGAUCUGAACCUGGACUCACCGCUGACUCCCGAGCUGAACGAAAUCC

UGGACACCUUCCUGAACGACGAGUGCCUUCUCCACGCCAUGCAUAUCUCCACCGGGCUGAGCAUCUUCGACACCUCGCUGUUC

UCGGGAGGAAAACGCCCGGCCGCAACUAAGAAGGCCGGACAGGCCAAGAAGAAGAAGGGGUCAUACCCCGUACGACGUGCCCGA

CUAUGCGUGAGCGGCCGCUUAAUUAAGCUGCCUUCUGCGGGGCUUGCCUUCUGGCCAUGCCCUUCUUCUCUCCCUUGCACCUG

UACCUCUUGGUCUUUGAAUAAAGCCUGAGUAGGAAGUCUAGAAAAAAAAAAAAAAAAAAAAAAAAAAAAAAAAAAAAAAAAAA

AAAAAAAAAAAAAAAAAAAAAAAAAAAAAAAAAAAAAAAAAAAAAAAAAAAAAAAAAAAA

>ZF5.2 mRNA sequence

SEQ ID NO.: 227

CUCGAACCCGGGGAAAAGCCGUACAAGUGUCCGGAGUGUGGGAAGUCAUUCUCCACUUCCGGGAAUCUGACCGAGCAUCAACG

CACCCACACUGGCGAGAAGCCCUACAAAUGCCCGGAGUGCGGAAAAUCGUUCUCGGACUCCGGGAACCUUCGGGUCCACCAAA

GGACUCAUACCGGGGAGAAACCGUACAAAUGUCCCGAAUGCGGGAAGUCGUUCAGCCAUAAGAACGCGCUGCAGAACCAUCAG

AGGACCCAUACUGGAGAAAAGCCCUAUAAGUGUCCGGAAUGCGGAAAGUCGUUCUCACGCAACGACACCCUCACCGAACACCA

GCGCACUCACACCGGAGAGAAGCCUUACAAGUGCCCGGAAUGUGGAAAGAGCUUCAGCCAGCGGGCACAUCUGGAAAGACACC

AGCGAACCCACACCGGGGAAAAACCGUAUAAGUGCCCCGAGUGUGGAAAGUCCUUUUCACGGUCCGAUAAGCUCGUGCGCCAC

CAGAGAACUCACACUGGGGAGAAGCCGUACAAGUGUCCCGAGUGCGGCAAGAGCUUCUCAGAUCCGGGACACCUUGUGCGACA

UCAACGGACCCAUACCGGAGAAAAACCGACCGGGAAAAAGACCUCA

>ZF5.3-VPR mRNA (ZF5-VPR ATUM Opt_3)

SEQ ID NO.: 162

AGGAAAUAAGAGAGAAAAGAAGAGUAAGAAGAAAUAUAAGAGCCACCAUGGCCCCCAAGAAGAAGCGCAAGGUCGGGAUCCAC

GGAGUCCCGGCAGCAGGAUCCUCAGGCUCACUGGAACGGGGGAAAAACCCUACAAGUGCCCGGAAUGCGGCAAGAGCUUCUC

GACCUCCGGGAACCUGACCGAGCACCAGCGCACCCACACCGGAGAGAAACCGUACAAGUGCCCCGAAUGCGGGAAAUCGUUCU

-continued

CAGACUCGGGAAACCUCAGGGUGCACCAGCGGACCCACACGGGGGAAAAGCCGUACAAAUGCCCGGAGUGCGGGAAGUCAUUC

UCCCACAAGAACGCGCUGCAGAACCACCAAAGAACCCACACCGGCGAAAAACCGUACAAGUGCCCCGAGUGCGGAAAGUCCUU

CUCCCGCAACGACACCCUCACCGAACACCAACGCACCCACACCGGAGAAAAGCCCUACAAGUGCCCGGAAUGCGGAAAGAGCU

UCAGCCAGAGGGCCCACCUGGAAAGACACCAGAGAACCCACACCGGCGAAAAGCCGUACAAAUGCCCGGAGUGCGGGAAGUCC

UUCAGCCGGUCAGACAAGCUGGUCCGCCACCAAAGGACCCACACAGGAGAAAAGCCCUACAAGUGCCCGGAAUGCGGAAAAUC

GUUCAGCGACCCCGGACACCUGGUCCGGCACCAGAGGACCCACACCGGGGAGAAGCCGACCGGCAAAAGACCUCAGCGAGCG

GAUCCGGAGGAGGAUCAGGGGGGGACGCACUGGACGACUUCGACCUGGACAUGCUGGAUCCGACGCACUGGACGACUUCGAC

CUAGACAUGCUCGGAUCGGACGCACUCGACGACUUCGACCUCGACAUGCUAGGAUCAGACGCACUAGACGACUUCGACCUCGA

CAUGCUGUCGGAGGACCGAAGAAAAAGCGGAAGGUCGGAUCACAGUACCUCCCGGACACCGACGACAGGCACAGAAUCGAAG

AAAAACGCAAGCGCACCUACGAAACCUUCAAGAGCAUCAUGAAAAAGUCGCCGUUCUCAGGACCGACCGACCCCAGACCGCCA

CCGAGGAGAAUAGCCGUCCCGAGCCGAUCCUCCGCAUCCGUGCCGAAACCGGCACCGCAACCCUACCCGUUCACCUCGUCCCU

GUCGACCAUCAACUACGACGAGUUCCCCACCAUGGUGUUCCCCUCCGGGCAGAUCUCACAGGCCUCGGCACUGGCACCCGCAC

CACCGCAAGUGCUGCCCCAAGCACCGGCACCCGCACCGGCGCCCGCAAUGGUGUCAGCGCUGGCACAGGCACCAGCACCGGUG

CCAGUCCUCGCACCGGGACCGCCGCAAGCAGUGGCACCGCCGGCACCGAAACCGACCCAGGCCGGAGAAGGGACCCUGUCCGA

GGCGCUGCUGCAACUCCAGUUCGACGACGAGGACCUGGGAGCACUCCUGGGAAACUCCACCGACCCGGCAGUGUUCACCGACC

UCGCAUCGGUGGACAACUCCGAGUUCCAACAGCUCCUGAACCAGGGGAUACCGGUGGCACCGCACACCACCGAACCGAUGCUG

AUGGAAUACCCGGAAGCCAUCACCCGGCUCGUGACCGGAGCGCAAAGACCGCCCGACCCCGCGCCCGCACCGCUGGGAGCACC

GGGACUACCGAACGGGCUGCUCUCAGGGGACGAGGACUUCUCCAGCAUCGCAGACAUGGACUUCUCCGCCCUGCUGGGAUCAG

GAUCCGGAUCACGCGACUCCCGGGAAGGAAUGUUCCUGCCGAAGCCGGAAGCAGGCAGCGCAAUCUCCGACGUGUUCGAAGGC

CGCGAGGUCUGCCAGCCCAAGCGCCUGCGACCGUUCCACCCGCCGGGAUCACCGUGGGCAAACCGCCCGCUACCGGCAUCACU

GGCACCGACACCCACCGGACCGGUGCACGAACCGGUCGGGUCACUGACCCCCGCACCGGUCCCGCAACCGCUAGACCCGGCAC

CGGCAGUGACCCCGGAAGCAUCGCACCUCCUGGAGGACCCGGACGAGGAAACCUCACAGGCAGUGAAGGCCCUGCGGGAGAUG

GCCGACACCGUGAUACCGCAGAAGGAGGAGGCCGCCAUCUGCGGACAAAUGGACCUGUCACACCCGCCCCCGAGAGGACACCU

GGACGAACUCACCACCACCCUGGAGAGCAUGACCGAGGACCUGAACCUGGACUCACCGCUGACCCCGGAGCUGAACGAAAUCC

UGGACACCUUCCUGAACGACGAGUGCCUGCUGCACGCAAUGCACAUCAGCACCGGGCUGUCGAUCUUCGACACCAGCCUGUUC

UCCGGAGGGAAAAGACCCGCCGCCACCAAGAAAGCGGGCCAAGCAAAGAAAAAGAAGGGAUCGUACCCCUACGACGUGCCGGA

CUACGCAUGAGCGGCCGCUUAAUUAAGCUGCCUUCUGCGGGGCUUGCCUUCUGGCCAUGCCCUUCUUCUCUCCCUUGCACCUG

UACCUCUUGGUCUUUGAAUAAAGCCUGAGUAGGAAGUCUAGAAAAAAAAAAAAAAAAAAAAAAAAAAAAAAAAAAAAAAAAAA

AAAAAAAAAAAAAAAAAAAAAAAAAAAAAAAAAAAAAAAAAAAAAAAAAAAAAAAA

>ZF5.3 mRNA

SEQ ID NO.: 228

CUGGAACCGGGGAAAAACCCUACAAGUGCCCGGAAUGCGGCAAGAGCUUCUCGACCUCCGGGAACCUGACCGAGCACCAGCG

CACCCACACCGGAGAGAAACCGUACAAGUGCCCCGAAUGCGGGAAAUCGUUCUCAGACUCGGGAAACCUCAGGGUGCACCAGC

GGACCCACACGGGGGAAAAGCCGUACAAAUGCCCGGAGUGCGGGAAGUCAUUCUCCCACAAGAACGCGCUGCAGAACCACCAA

AGAACCCACACCGGCGAAAAACCGUACAAGUGCCCCGAGUGCGGAAAGUCCUUCUCCCGCAACGACACCCUCACCGAACACCA

ACGCACCCACACCGGAGAAAAGCCCUACAAGUGCCCGGAAUGCGGAAAGAGCUUCAGCCAGAGGGCCCACCUGGAAAGACACC

AGAGAACCCACACCGGCGAAAAGCCGUACAAAUGCCCGGAGUGCGGGAAGUCCUUCAGCCGGUCAGACAAGCUGGUCCGCCAC

CAAAGGACCCACACAGGAGAAAAGCCCUACAAGUGCCCGGAAUGCGGAAAAUCGUUCAGCGACCCCGGACACCUGGUCCGGCA

CCAGAGGACCCACACCGGGGAGAAGCCGACCGGCAAAAAGACCUCA

>ZF5.4-VPR mRNA (ZF5-VPR ATUM Opt_4)
SEQ ID NO.: 163
AGGAAAUAAGAGAGAAAAGAAGAGUAAGAAGAAAUAUAAGAGCCACCAUGGCCCCGAAGAAAAAGAGGAAGGUCGGGAUCCAC

GGAGUCCCAGCCGCAGGAAGCAGCGGAAGCCUGGAACCCGGAGAAAAACCCUACAAGUGCCCAGAAUGCGGCAAGAGCUUCAG

CACCAGCGGAAACCUGACCGAACACCAGCGGACGCACACAGGGGAGAAACCGUACAAAUGCCCGGAGUGCGGAAAGAGCUUCA

GCGACAGCGGCAACCUCCGCGUGCACCAGAGAACCCACACGGGAGAGAAGCCGUACAAGUGCCCGGAAUGCGGAAAAAGCUUC

AGCCACAAGAACGCGCUGCAGAACCACCAGAGGACACACACGGGCGAGAAGCCCUACAAAUGCCCCGAAUGCGGGAAAAGCUU

CAGCCGGAACGACACCCUCACCGAGCACCAGCGAACCCACACCGGAGAAAAGCCGUACAAGUGCCCGGAAUGCGGAAAAAGCU

UCAGCCAACGGGCCCACCUGGAACGCCACCAAAGGACCCACACAGGAGAAAAGCCCUACAAGUGCCCAGAGUGCGGCAAAAGC

UUCAGCCGGAGCGACAAGCUGGUCCGGCACCAGCGCACACACACCGGCGAAAAGCCAUACAAGUGCCCCGAGUGCGGAAAGAG

CUUCAGCGACCCAGGACACCUCGUGCGGCACCAACGCACGCACACCGGGGAAAAACCGACCGGAAAAAAGACCAGCGCGAGCG

GAAGCGGAGGAGGAAGCGGAGGCGACGCCCUGGACGACUUCGACCUGGACAUGCUGGGGAGCGACGCACUGGACGACUUCGAC

CUGGACAUGCUGGGAAGCGACGCGCUGGACGACUUCGACCUGGACAUGCUGGGCAGCGACGCCCUCGACGACUUCGACCUCGA

CAUGCUGAGCGGCGGACCCAAGAAGAAGAGAAAGGUCGGAAGCCAGUACCUCCCGGACACCGACGACAGGCACCGCAUCGAAG

AGAAGCGGAAAAGAACCUACGAAACCUUCAAGAGCAUCAUGAAAAAGAGCCCGUUCAGCGGACCAACCGACCCCAGACCACCA

CCGAGAAGAAUCGCGGUCCCAAGCAGGAGCAGCGCCAGCGUCCCGAAGCCAGCCCCACAGCCGUACCCCUUCACCAGCAGCCU

GAGCACCAUCAACUACGACGAGUUCCCCACCAUGGUGUUCCCGAGCGGCCAGAUAAGCCAGGCCAGCGCACUGGCACCAGCCC

CACCGCAAGUGCUGCCCCAAGCACCCGCACCAGCACCCGCCCCCGCGAUGGUCAGCGCCCUGGCACAAGCCCCAGCCCCAGUC

CCGGUGCUCGCACCAGGACCACCCCAAGCAGUCGCACCGCCAGCCCCAAAGCCGACCCAAGCGGAGAAGGCACCCUCAGCGA

GGCGCUCCUGCAACUCCAAUUCGACGACGAGGACCUGGGAGCCCUGCUGGGCAACAGCACCGACCCGGCAGUGUUCACCGACC

UGGCCAGCGUGGACAACAGCGAAUUCCAGCAGCUCCUGAACCAAGGAAUCCCAGUCGCGCCACACACCACCGAGCCGAUGCUG

AUGGAAUACCCAGAAGCGAUCACGAGACUGGUCACCGGGGCCCAAAGACCGCCGACCCAGCGCCAGCACCACUGGGAGCCCC

AGGACUGCCCAACGGACUGCUCAGCGGCGACGAGGACUUCAGCAGCAUCGCGGACAUGGACUUCAGCGCACUCCUCGGAAGCG

GAAGCGGCAGCAGAGACAGCCGGGAAGGAAUGUUCCUCCCCAAGCCAGAAGCGGAAGCGCAAUCAGCGACGUGUUCGAAGGA

CGGGAAGUCUGCCAGCCGAAGCGCCUCAGACCCGUUCCACCCACCGGGAAGCCCAUGGGCCAACAGACCGCUGCCAGCCAGCCU

GGCACCGACCCCAACCGGACCAGUCCACGAACCAGUCGGCAGCCUGACACCAGCACCAGUGCCCCAGCCACUGGACCCAGCAC

CGGCAGUGACCCCAGAAGCCAGCCACCUCCUGGAGGACCCCGACGAAGAAACCAGCCAGGCCGUGAAGGCCCUGAGGGAGAUG

GCCGACACGGUGAUCCCACAGAAGGAAGAAGCAGCGAUCUGCGGCCAAAUGGACCUCAGCCACCCACCGCCAAGAGGCCACCU

GGACGAGCUCACCACCACCCUGGAAAGCAUGACCGAGGACCUCAACCUCGACAGCCCCCUGACACCGGAGCUCAACGAGAUCC

UGGACACCUUCCUCAACGACGAAUGCCUGCUCCACGCCAUGCACAUCAGCACCGGACUGAGCAUCUUCGACACCAGCCUGUUC

AGCGGGGGAAAACGACCGGCAGCCACCAAAAAGGCCGGACAGGCGAAGAAGAAGAAGGGGAGCUACCCGUACGACGUGCCCGA

CUACGCCUGAGCGGCCGCUUAAUUAAGCUGCCUUCUGCGGGCUUGCCUUCUGGCCAUGCCCUUCUUCUCUCCCUUGCACCUG

UACCUCUUGGUCUUUGAAUAAAGCCUGAGUAGGAAGUCUAGAAAAAAAAAAAAAAAAAAAAAAAAAAAAAAAAAAAAAAAAAA

AAAAAAAAAAAAAAAAAAAAAAAAAAAAAAAAAAAAAAAAAAAAAAAAAAAAAAAAAAAAA

>ZF5.4 mRNA sequence
SEQ ID NO.: 229
CUGGAACCCGGAGAAAAACCCUACAAGUGCCCAGAAUGCGGCAAGAGCUUCAGCACCAGCGGAAACCUGACCGAACACCAGCG GACGCACACAGGGGAGAAACCGUACAAAUGCCCGGAGUGCGGAAAGAGCUUCAGCGACAGCGGCAACCUCCGCGUGCACCAGA GAACCCACACGGGAGAGAAGCCGUACAAGUGCCCGGAAUGCGGAAAAAGCUUCAGCCACAAGAACGCGCUGCAGAACCACCAG AGGACACACACGGGCGAGAAGCCCUACAAAUGCCCCGAAUGCGGGAAAAGCUUCAGCCGGAACGACACCCUCACCGAGCACCA GCGAACCCACACCGGAGAAAAGCCGUACAAGUGCCCGGAAUGCGGAAAAAGCUUCAGCCAACGGGCCCACCUGGAACGCCACC AAAGGACCCACACAGGAGAAAAGCCCUACAAGUGCCCAGAGUGCGGCAAAAGCUUCAGCCGGAGCGACAAGCUGGUCCGGCAC -continued CAGCGCACACACACCGGCGAAAAGCCAUACAAGUGCCCCGAGUGCGGAAAGAGCUUCAGCGACCCAGGACACCUCGUGCGGCA

CCAACGCACGCACACCGGGGAAAAACCGACCGGAAAAAAGACCAGC

>ZF5.5-VPR  (ZF5-VPR ATUM Opt_5)

SEQ ID NO.: 164

AGGAAAUAAGAGAGAAAAGAAGAGUAAGAAGAAAUAUAAGAGCCACCAUGGCCCCGAAGAAGAAGCGCAAGGUCGGCAUACAC

GGAGUCCCAGCCGCUGGAUCCUCCGGAUCCCUGGAACCUGGGGAGAAACCCUAUAAGUGCCCGGAGUGCGGAAAGUCAUUCUC

AACUAGCGGAAACCUGACAGAGCACCAGAGGACCCAUACUGGCGAAAAGCCAUACAAAUGCCCCGAAUGCGGGAAAAGCUUCA

GCGACAGCGGGAACCUGAGAGUGCACCAGCGGACUCAUACCGGGGAGAAGCCUUACAAGUGCCCCGAGUGUGGAAAGUCCUUC

UCCCAUAAGAACGCGCUCCAGAACCACCAGAGAACCCACACCGGAGAAAAGCCGUACAAGUGCCCGGAAUGCGGCAAAUCCUU

UUCACGGAACGACACUCUCACCGAGCACCAACGGACGCACACCGGAGAGAAGCCGUACAAGUGCCCUGAAUGCGGAAAGAGCU

UUAGCCAGAGGGCCCACCUGGAACGGCAUCAGCGCACUCACACCGGGGAAAAGCCCUACAAGUGCCCAGAGUGCGGCAAGAGC

UUCUCCCGGUCUGACAAGCUUGUGCGCCAUCAGCGGACCCACACUGGAGAAAAACCGUACAAGUGUCCGGAGUGUGGCAAAUC

GUUCUCAGACCCGGGACACCUGGUCCGACACCAACGCACACACACCGGCGAAAAGCCGACCGGCAAAAAGACCUCGGCCUCGG

GAUCUGGAGGAGGAAGCGGCGGAGAUGCCCUGGACGACUUCGACCUGGACAUGUUGGGCAGCGACGCACUGGAUGACUUCGAC

CUGGAUAUGCUGGGAUCCGACGCCCUCGACGAUUUCGACCCUCGAUAUGCUUGGCUCCGAUGCGCUCGAUGAUUUCGAUUUGGA

CAUGCUGUCCGGCGACCUAAGAAGAAGAGAAAGGUCGGCAGCCAAUACCUCCCGGACACUGAUGACCGGCACCGGAUCGAAG

AGAAGCGGAAGCGCACUUACGAGACUUUCAAGUCGAUCAUGAAGAAGUCACCCUUCUCGGGACCUACUGAUCCUCGGCCGCCA

CCUAGACGGAUCGCGGUGCAUCCAGGUCAUCCGCUUCCGUCCCCAAGCCUGCGCCUCAACCGUACCCUUUCACUUCCUCCCU

GUCGACCAUCAACUACGACGAGUUCCCCACCAUGGUGUUCCCCUCCGGACAGAUUUCCCAAGCCUCGGCGCUAGCACCAGCCC

CUCCACAAGUGCUUCCGCAAGCUCCAGCUCCGGCACCAGCACCAGCCAUGGUGUCCGCUCUGGCCCAAGCUCCUGCUCCGGUG

CCUGUGCUGGCUCCUGGACCGCCUCAGGCAGUGGCACCACCCGCACCAAAGCCGACCCAAGCGGGAGAGGGAACUCUGUCCGA

AGCGCUGCUGCAGCUCCAGUUCGACGACGAGGACCUGGGUGCCCUGCUCGGAAAUUCGACCGAUCCGGCCGUGUUUACCGACU

UGGCCAGUGUGGACAACUCCGAGUUCCAACAGCUGCUGAACCAGGGGAUUCCAGUGGCCCCCCACACUACUGAACCGAUGCUG

AUGGAAUACCCCGAGGCCAUUACCAGACUGGUCACUGGAGCCCAGAGGCCUCCAGACCCUGCCCCUGCUCCACUGGGUGCCCC

AGGACUGCCCAAUGGGCUUCUGUCGGGCGAUGAGGAUUUCAGCUCAAUCGCGGAUAUGGACUUCUCCGCCCUUCUGGGUUCCG

GAUCCGGUUCACGGGAUUCCAGAGAGGGCAUGUUCCUACCCAAGCCCGAAGCCGGAAGCGCGAUCAGCGACGUGUUCGAGGGU

CGCGAAGUCUGUCAGCCAAAGAGACUCCGGCCGUUUCAUCCACCCGGAUCACCCUGGGCCAAUCGCCCACUCCCUGCCUCAUU

GGCCCCGACCCCUACUGGUCCGGUGCACGAGCUGUCGGGUCGCUCACUCCGGCACCUGUGCCACAACCGCUGGACCCUGCAC

CAGCCGUGACCCCAGAGGCGUCCCACCUCCUCGAAGAUCCCGAUGAAGAAACAAGCCAGGCCGUGAAGGCCCUGCGCGAAAUG

GCCGACACCGUGAUCCCGCAGAAAGAGGAAGCCGCCAUCUGCGGUCAGAUGGACCUGAGCCAUCCCCUCCGAGAGGACACCU

GGACGAACUGACCACUACACUGGAGAGCAUGACCGAGGACCUGAACCUGGACUCCCCCUUACCCCGGAACUGAACGAGAUUC

UCGACACUUUCCUGAACGACGAGUGUCUGCUCCACGCGAUGCACAUCUGACCGGACUGUCGAUCUUUGACACCUCGCUGUUC

UCCGGUGGCAAAAGGCCUGCCGCCACCAAGAAGGCCGGACAGGCCAAGAAAAAGAAGGGCUCCUACCCGUACGAUGUGCCCGA

CUACGCUUGAGCGGCCGCUUAAUUAAGCUGCCUUCUGCGGGGCUUGCCUUCUGGCCAUGCCCUUCUUCUCUCCCUUGCACCUG

UACCUCUUGGUCUUUGAAUAAAGCCUGAGUAGGAAGUCUAGAAAAAAAAAAAAAAAAAAAAAAAAAAAAAAAAAAAAAAAAAA

AAAAAAAAAAAAAAAAAAAAAAAAAAAAAAAAAAAAAAAAAAAAAAAAAAAAAAAAA

>ZF5.5 mRNA

SEQ ID NO.: 230

CUGGAACCUGGGGAGAAACCCUAUAAGUGCCCGGAGUGCGGAAAGUCAUUCUCAACUAGCGGAAACCUGACAGAGCACCAGAG

GACCCAUACUGGCGAAAAGCCAUACAAAUGCCCCGAAUGCGGGAAAAGCUUCAGCGACAGCGGGAACCUGAGAGUGCACCAGC

GGACUCAUACCGGGGAGAAGCCUUACAAGUGCCCCGAGUGUGGAAAGUCCUUCUCCCAUAAGAACGCGCUCCAGAACCACCAG

AGAACCCACACCGGAGAAAAGCCGUACAAGUGCCCGGAAUGCGGCAAAUCCUUUUCACGGAACGACACUCUCACCGAGCACCA

ACGGACGCACACCGGAGAGAAGCCGUACAAGUGCCCUGAAUGCGGAAAGAGCUUUAGCCAGAGGGCCCACCUGGAACGGCAUC

```
AGCGCACUCACACCGGGGAAAAGCCCUACAAGUGCCCAGAGUGCGGCAAGAGCUUCUCCCGGUCUGACAAGCUUGUGCGCCAU

CAGCGGACCCACACUGGAGAAAAACCGUACAAGUGUCCGGAGUGUGGCAAAUCGUUCUCAGACCCGGGACACCUGGUCCGACA

CCAACGCACACACACCGGCGAAAAGCCGACCGGCAAAAAGACCUCG
```

>ZF5.6-VPR mRNA (ZF5-VPR ATUM Opt_6)
SEQ ID NO.: 165

```
AGGAAAUAAGAGAGAAAAGAAGAGUAAGAAGAAAUAUAAGAGCCACCAUGGCCCCCAAGAAAAAGCGCAAGUGGGCAUCCAC

GGCGUGCCAGCAGCAGGAAGCAGCGGAAGCCUGGAACCCGGGGAGAAGCCGUACAAGUGCCCAGAAUGCGGAAAGAGCUUCAG

CACCAGCGGCAACCUCACCGAGCACCAGAGAACCCACACCGGGGAGAAACCGUACAAAUGCCCGGAAUGCGGCAAGAGCUUCA

GCGACAGCGGAAACCUGAGAGUGCACCAACGCACCCACACGGGAGAAAAACCCUACAAAUGCCCCGAGUGCGGGAAAAGCUUC

AGCCACAAGAACGCGCUGCAGAACCACCAAAGAACGCACACCGGAGAAAAGCCGUACAAGUGCCCAGAAUGCGGAAAGAGCUU

CAGCAGAAACGACACCCUGACCGAACACCAGCGGACGCACACAGGCGAAAAACCAUACAAGUGCCCGGAGUGCGGCAAAAGCU

UCAGCCAGAGAGCGCACCUGGAAAGGCACCAGCGCACACACACCGGCGAAAAGCCAUACAAAUGCCCAGAGUGCGGAAAAAGC

UUCAGCCGGAGCGACAAGCUGGUCCGCCACCAACGGACCCACACAGGGGAAAAGCCCUACAAGUGCCCCGAAUGCGGCAAGAG

CUUCAGCGACCCGGGACACCUCGUGCGGCACCAGAGGACCCACACCGGAGAAAGCCGACCGGGAAAAAGACCAGCGCAAGCG

GGAGCGGAGGAGGAAGCGGAGGCGACGCACUCGACGACUUCGACCUGGACAUGCUGGGGAGCGACGCACUGGACGACUUCGAC

CUCGACAUGCUCGGAAGCGACGCCCUCGACGACUUCGACCUGGACAUGCUGGGCAGCGACGCGCUGGACGACUUCGACCUCGA

CAUGCUCAGCGGGGGACCAAAAAAGAAAAGGAAGGUCGGAAGCCAGUACCUCCCGGACACCGACGACAGGCACCGGAUCGAGG

AAAAGCGGAAGCGCACCUACGAAACCUUCAAGAGCAUCAUGAAAAAGAGCCCCUUCAGCGGACCGACAGACCCGAGGCCACCA

CCACGGAGAAUCGCCGUGCCAAGCAGGAGCAGCGCCAGCGUGCCCAAACCGGCCCCACAACCCUACCCGUUCACCAGCAGCCU

CAGCACCAUCAACUACGACGAGUUCCCAACCAUGGUGUUCCCCAGCGGACAGAUCAGCCAAGCCAGCGCACUGGCACCAGCCC

CCCCGCAAGUGCUGCCACAAGCGCCGGCACCAGCGCCAGCACCAGCCAUGGUCAGCGCGCUGGCACAAGCCCCCGCACCAGUG

CCAGUGCUCGCACCAGGACCACCCCAGGCAGUAGCACCGCCAGCCCCGAAGCCAACCCAGGCAGGAGAAGGCACCCUCAGCGA

GGCGCUGCUGCAGCUCCAGUUCGACGACGAGGACCUCGGAGCCCUGCUGGGAAACAGCACCGACCCAGCCGUGUUCACCGACC

UGGCCAGCGUGGACAACAGCGAAUUCCAGCAGCUGCUCAACCAAGGAAUCCCGGUGGCCCCACACACCACCGAACCCAUGCUG

AUGGAGUACCCGGAGGCCAUCACCAGACUCGUGACAGGAGCCCAGAGGCCACCAGACCCAGCCCCAGCACCACUGGGGAGCCCC

AGGACUCCCCAACGGACUGCUGAGCGGCGACGAGGACUUCAGCAGCAUCGCCGACAUGGACUUCAGCGCACUCCUCGGGAGCG

GAAGCGGAAGCAGAGACAGCAGGGAAGGAAUGUUCCUGCCCAAGCCGGAAGCGGGAAGCGCAAUCAGCGACGUGUUCGAAGGA

AGAGAAGUCUGCCAGCCCAAGAGGCUGCGCCCGUUCCACCCACCAGGAAGCCCGUGGGCAACAGACCACUGCCAGCAAGCCU

CGCCCCGACACCAACCGGACCGGUGCACGAACCCGUGGGCAGCCUGACCCCAGCACCGGUCCCACAGCCACUGGACCCAGCAC

CCGCAGUGACCCCAGAAGCCAGCCACCUCCUGGAGGACCCGGACGAAGAAACCAGCCAGGCCGUCAAGGCCCUGCGCGAGAUG

GCCGACACCGUCAUCCCCCAAAAGGAAGAGGCGGCCAUCUGCGGACAGAUGGACCUGAGCCACCCACCGCCAAGAGGCCACCU

CGACGAGCUGACCACCACCCUGGAAAGCAUGACGGAGGACCUGAACCUCGACAGCCCGCUAACGCCCGAGCUGAACGAAAUCC

UGGACACCUUCCUCAACGACGAAUGCCUGCUGCACGCCAUGCACAUCAGCACCGGACUGAGCAUCUUCGACACGAGCCUGUUC

AGCGGAGGAAAACGGCCAGCCGCAACCAAGAAGGCCGGACAAGCCAAGAAGAAGAAGGGGAGCUACCCGUACGACGUGCCAGA

CUACGCAUGAGCGGCCGCUUAAUUAAGCUGCCUUCUGCGGGGCUUGCCUUCUGGCCAUGCCCUUCUUCUCUCCCUUGCACCUG

UACCUCUUGGUCUUUGAAUAAAGCCUGAGUAGGAAGUCUAGAAAAAAAAAAAAAAAAAAAAAAAAAAAAAAAAAAAAAAAAAA

AAAAAAAAAAAAAAAAAAAAAAAAAAAAAAAAAAAAAAAAAAAAAAAAAAAAAAAAAAAAAAA
```

>ZF5.6 mRNA
SEQ ID NO.: 231

```
CUGGAACCCGGGGAGAAGCCGUACAAGUGCCCAGAAUGCGGAAAGAGCUUCAGCACCAGCGGCAACCUCACCGAGCACCAGAG

AACCCACACCGGGGAGAAACCGUACAAAUGCCCGGAAUGCGGCAAGAGCUUCAGCGACAGCGGAAACCUGAGAGUGCACCAAC

GCACCCACACGGGAGAAAAACCCUACAAAUGCCCCGAGUGCGGGAAAAGCUUCAGCCACAAGAACGCGCUGCAGAACCACCAA
```

-continued

AGAACGCACACCGGAGAAAAGCCGUACAAGUGCCCAGAAUGCGGAAAGAGCUUCAGCAGAAACGACACCCUGACCGAACACCA

GCGGACGCACACAGGCGAAAAACCAUACAAGUGCCCGGAGUGCGGCAAAAGCUUCAGCCAGAGAGCGCACCUGGAAAGGCACC

AGCGCACACACACCGGCGAAAAGCCAUACAAAUGCCCAGAGUGCGGAAAAAGCUUCAGCCGGAGCGACAAGCUGGUCCGCCAC

CAACGGACCCACACAGGGGAAAAGCCCUACAAGUGCCCCGAAUGCGGCAAGAGCUUCAGCGACCCGGGACACCUCGUGCGGCA

CCAGAGGACCCACACCGGAGAAAAGCCGACCGGGAAAAAGACCAGC

>ZF5-P300 protein

SEQ ID NO.: 166

MAPKKKRKVGIHGVPAAGSSGSLEPGEKPYKCPECGKSFSQRAHLERHQRTHTGEKPYKCPECGKSFSQLAHLRAHQRTHTGE

KPYKCPECGKSFSSKKHLAEHQRTHTGEKPYKCPECGKSFSTTGALTEHQRTHTGEKPYKCPECGKSFSTSGNLVRHQRTHTG

EKPYKCPECGKSFSQSGDLRRHQRTHTGEKPYKCPECGKSFSTSHSLTEHQRTHTGEKPTGKKTSASGSGGGSGGIFKPEELR

QALMPTLEALYRQDPESLPFRQPVDPQLLGIPDYFDIVKSPMDLSTIKRKLDTGQYQEPWQYVDDIWLMFNNAWLYNRKTSRV

YKYCSKLSEVFEQEIDPVMQSLGYCCGRKLEFSPQTLCCYGKQLCTIPRDATYYSYQNRYHFCEKCFNEIQGESVSLGDDPSQ

PQTTINKEQFSKRKNDTLDPELFVECTECGRKMHQICVLHHEIIWPAGFVCDGCLKKSARTRKENKFSAKRLPSTRLGTFLEN

RVNDFLRRQNHPESGEVTVRVVHASDKTVEVKPGMKARFVDSGEMAESFPYRTKALFAFEEIDGVDLCFFGMHVQEYGSDCPP

PNQRRVYISYLDSVHFFRPKCLRTAVYHEILIGYLEYVKKLGYTTGHIWACPPSEGDDYIFHCHPPDQKIPKPKRLQEWYKKM

LDKAVSERIVHDYKDIFKQATEDRLTSAKELPYFEGDFWPNVLEESIKELEQEEEERKREENTSNESTDVTKGDSKNAKKKNN

KKTSKNKSSLSRGNKKKPGMPNVSNDLSQKLYATMEKHKEVFFVIRLIAGPAANSLPPIVDPDPLIPCDLMDGRDAFLTLARD

KHLEFSSLRRAQWSTMCMLVELHTQSQDSGGKRPAATKKAGQAKKKKGSYPYDVPDYA*

>ZF5-P300 mRNA

SEQ ID NO.: 167

AGGAAAUAAGAGAGAAAAGAAGAGUAAGAAGAAAUAUAAGAGCCACCAUGGCCCCCAAGAAGAAGCGGAAGGUGGGCAUCCAC

GGCGUGCCCGCCGCCGGCAGCAGCGGAUCCCUCGAACCGGGCGAAAAGCCGUAUAAGUGCCCGGAAUGCGGCAAGAGUUUUAG

CCAGCGCGCCCAUCUGGAACGUCACCAGCGUACCCAUACCGGUGAAAAGCCAUAUAAAUGCCCAGAAUGUGGUAAAAGCUUUA

GUCAGCUGGCCCAUCUGCGCGCCCACCAACGUACGCACACGGGCGAGAAGCCGUACAAAUGCCCAGAAUGCGGUAAAAGCUUC

AGCAGCAAAAAGCAUCUGGCGGAACAUCAACGUACCCACACCGGCGAGAAACCAUACAAGUGCCCGGAAUGCGGUAAAAGCUU

CAGCACCACCGGUGCGCUGACGGAGCAUCAGCGCACCCACACGGGCGAAAAACCGUAUAAGUGUCCGGAGUGUGGCAAAAGUU

UUAGUACCAGCGGCAAUCUGGUGCGCCAUCAACGUACGCAUACCGGCGAGAAGCCAUAUAAAUGUCCAGAGUGUGGCAAGAGC

UUUAGCCAAAGCGGUGAUCUGCGUCGCCACCAACGCACGCACACCGGCGAAAAACCAUACAAAUGUCCGGAAUGCGGUAAGAG

UUUCAGCACGAGCCAUAGUCUGACCGAACAUCAACGUACCCAUACGGGUGAGAAACCAACCGGCAAGAAAACCAGCGCUAGCG

GCAGCGGCGGCGGCAGCGGCGGCAUCUUCAAGCCCGAGGAGCUGCGGCAGGCCCUGAUGCCCACCCUGGAGGCCCUGUACCGG

CAGGACCCCGAGAGCCUGCCCUUCCGGCAGCCCGUGGACCCCCAGCUGCUGGGCAUCCCCGACUACUUCGACAUCGUGAAAUC

CCCCAUGGACCUGAGCACCAUCAAGCGGAAGCUGGACACCGGCCAGUACCAGGAGCCCUGGCAGUACGUGGACGACAUCUGGC

UGAUGUUCAACAACGCCUGGCUGUACAACCGGAAAACCAGCCGGGUGUACAAGUACUGCAGCAAGCUGAGCGAGGUGUUCGAG

CAGGAGAUCGACCCCGUGAUGCAGAGCCUGGGCUACUGCUGCGGCCGGAAGCUGGAGUUCAGCCCCCAGACCCUGUGCUGCUA

CGGCAAGCAGCUGUGCACCAUCCCCCGGGACGCCACCUACUACAGCUACCAGAACCGGUACCACUUCUGCGAGAAGUGCUUCA

ACGAGAUCCAGGGCGAGAGCGUGAGCCUGGGCGACGACCCCAGCCAGCCCCAGACCACCAUCAACAAGGAGCAGUUCAGCAAG

CGGAAGAACGACACCCUGGACCCCGAGCUGUUCGUGGAGUGCACCGAGUGCGGCCGGAAGAUGCACCAGAUCUGCGUGCUGCA

CCACGAGAUCAUCUGGCCCGCCGGCUUCGUGUGCGACGGCUGCCUGAAGAAAUCCGCCCGGACCCGGAAGGAGAACAAGUUCA

GCGCCAAGCGGCUGCCCAGCACCCGGCUGGGCACCUUCCUGGAGAACCGGGUGAACGACUUCCUGCGGCGGCAGAACCACCCC

GAGAGCGGCGAGGUGACCGUGCGGGUGGUGCACGCCAGCGACAAGACCGUGGAGGUGAAGCCCGGCAUGAAGGCCCGGUUCGU

GGACAGCGGCGAGAUGGCCGAGAGCUUCCCCUACCGGACCAAGGCCCUGUUCGCCUUCGAGGAGAUCGACGGCGUGGACCUGU

GCUUCUUCGGCAUGCACGUGCAGGAGUACGGCAGCGACUGCCCCCCCCCCAACCAGCGGCGGGUGUACAUCAGCUACCUGGAC

AGCGUGCACUUCUUCCGGCCCAAGUGCCUGCGGACCGCCGUGUACCACGAGAUCCUGAUCGGCUACCUGGAGUACGUGAAGAA

GCUGGGCUACACCACCGGCCACAUCUGGGCCUGCCCCCCCAGCGAGGGCGACGACUACAUCUUCCACUGCCACCCCCCCGACC

AGAAGAUCCCCAAGCCCAAGCGGCUGCAGGAGUGGUACAAGAAGAUGCUGGACAAGGCCGUGAGCGAGCGGAUCGUGCACGAC

UACAAGGACAUCUUCAAGCAGGCCACCGAGGACCGGCUGACCAGCGCCAAGGAGCUGCCCUACUUCGAGGGCGACUUCUGGCC

CAACGUGCUGGAGGAGAGCAUCAAGGAGCUGGAGCAGGAGGAGGAGGAGCGGAAGCGGGAGGAGAACACCAGCAACGAGAGCA

CCGACGUGACCAAGGGCGACAGCAAGAACGCCAAGAAGAAGAACAACAAGAAAACCAGCAAGAACAAGAGCAGCCUGAGCCGG

GGCAACAAGAAGAAGCCCGGCAUGCCCAACGUGAGCAACGACCUGAGCCAGAAGCUGUACGCCACCAUGGAGAAGCACAAGGA

GGUGUUCUUCGUGAUCCGGCUGAUCGCCGGCCCCGCCGCCAACAGCCUGCCCCCCAUCGUGGACCCCGACCCCCUGAUCCCCU

GCGACCUGAUGGACGGCCGGGACGCCUUCCUGACCCUGGCCCGGGACAAGCACCUGGAGUUCAGCAGCCUGCGGCGGGCCCAG

UGGAGCACCAUGUGCAUGCUGGUGGAGCUGCACACCCAGAGCCAGGACAGCGGCGGCAAGCGGCCCGCCGCCACCAAGAAGGC

CGGCCAGGCCAAGAAGAAGAAGGGCAGCUACCCCUACGACGUGCCCGACUACGCCUGAGCGGCCGCUUAAUUAAGCUGCCUUC

UGCGGGGCUUGCCUUCUGGCCAUGCCCUUCUUCUCUCCCUUGCACCUGUACCUCUUGGUCUUUGAAUAAAGCCUGAGUAGGAA

GUCUAGAAAAAAAAAAAAAAAAAAAAAAAAAAAAAAAAAAAAAAAAAAAAAAAAAAAAAAAAAAAAAAAAAAAAAAAAAAAAA

AAA

>Nucleotide Seqeunce of DNA binding domain of ZF5-P300
SEQ ID NO.: 232
CUCGAACCGGGCGAAAAGCCGUAUAAGUGCCCGGAAUGCGGCAAGAGUUUUAGCCAGCGCGCCCAUCUGGAACGUCACCAGCG UACCCAUACCGGUGAAAAGCCAUAUAAAUGCCCAGAAUGUGGUAAAAGCUUUAGUCAGCUGGCCCAUCUGCGCGCCCACCAAC GUACGCACACGGGCGAGAAGCCGUACAAAUGCCCAGAAUGCGGUAAAAGCUUCAGCAGCAAAAAGCAUCUGGCGGAACAUCAA CGUACCCACACCGGCGAGAAACCAUACAAGUGCCCGGAAUGCGGUAAAAGCUUCAGCACCACCGGUGCGCUGACGGAGCAUCA GCGCACCCACACGGGCGAAAAACCGUAUAAGUGUCCGGAGUGUGGCAAAAGUUUUAGUACCAGCGGCAAUCUGGUGCGCCAUC AACGUACGCAUACCGGCGAGAAGCCAUAUAAAUGUCCAGAGUGUGGCAAGAGCUUUAGCCAAAGCGGUGAUCUGCGUCGCCAC CAACGCACGCACACCGGCGAAAAACCAUACAAAUGUCCGGAAUGCGGUAAGAGUUUCAGCACGAGCCAUAGUCUGACCGAACA

UCAACGUACCCAUACGGGUGAGAAACCAACCGGCAAGAAACCAGC

>ZF7-p300 protein
SEQ ID NO.: 168
MAPKKKRKVGIHGVPAAGSSGSLEPGEKPYKCPECGKSFSRSDHLTNHQRTHTGEKPYKCPECGKSFSTSGSLVRHQRTHTGE KPYKCPECGKSFSQAGHLASHQRTHTGEKPYKCPECGKSFSRSDKLTEHQRTHTGEKPYKCPECGKSFSTSGNLTEHQRTHTG EKPYKCPECGKSFSQSSNLVRHQRTHTGEKPYKCPECGKSFSTHLDLIRHQRTHTGEKPTGKKTSASGSGGGSGGIFKPEELR QALMPTLEALYRQDPESLPFRQPVDPQLLGIPDYFDIVKSPMDLSTIKRKLDTGQYQEPWQYVDDIWLMFNNAWLYNRKTSRV YKYCSKLSEVFEQEIDPVMQSLGYCCGRKLEFSPQTLCCYGKQLCTIPRDATYYSYQNRYHFCEKCFNEIQGESVSLGDDPSQ PQTTINKEQFSKRKNDTLDPELFVECTECGRKMHQICVLHHEIIWPAGFVCDGCLKKSARTRKENKFSAKRLPSTRLGTFLEN RVNDFLRRQNHPESGEVTVRVVHASDKTVEVKPGMKARFVDSGEMAESFPYRTKALFAFEEIDGVDLCFFGMHVQEYGSDCPP PNQRRVYISYLDSVHFFRPKCLRTAVYHEILIGYLEYVKKLGYTTGHIWACPPSEGDDYIFHCHPPDQKIPKPKRLQEWYKKM LDKAVSERIVHDYKDIFKQATEDRLTSAKELPYFEGDFWPNVLEESIKELEQEEEERKREENTSNESTDVTKGDSKNAKKKNN KKTSKNKSSLSRGNKKKPGMPNVSNDLSQKLYATMEKHKEVFFVIRLIAGPAANSLPPIVDPDPLIPCDLMDGRDAFLTLARD

KHLEFSSLRRAQWSTMCMLVELHTQSQDSGGKRPAATKKAGQAKKKKGSYPYDVPDYA*

>ZF7-p300 mRNA
SEQ ID NO.: 169
AGGAAAUAAGAGAGAAAAGAAGAGUAAGAAGAAAUAUAAGAGCCACCAUGGCCCCCAAGAAGAAGCGGAAGGUGGGCAUCCAC

GGCGUGCCCGCCGCCGGCAGCAGCGGAUCCCUGGAACCGGGCGAGAAGCCAUACAAGUGCCCAGAGUGCGGCAAAAGCUUCAG

CCGCAGCGACCAUCUGACCAAUCACCAACGCACCCAUACCGGUGAGAAGCCGUACAAAUGCCCAGAGUGCGGUAAGAGCUUUA

GUACCAGUGGCAGUCUGGUUCGUCAUCAGCGCACGCACACGGGCGAAAAACCAUACAAAUGCCCGGAGUGCGGCAAAAGCUUU

AGCCAAGCCGGUCAUCUGGCGAGCCAUCAACGUACGCACACCGGCGAGAAGCCGUAUAAAUGUCCGGAGUGCGGUAAGAGCUU

-continued

UAGCCGUAGCGAUAAACUGACCGAACACCAACGUACGCAUACGGGCGAGAAACCAUAUAAAUGUCCAGAGUGUGGCAAGAGUU

UCAGCACCAGCGGCAAUCUGACCGAGCAUCAACGUACCCAUACCGGUGAAAAGCCAUAUAAAUGUCCAGAAUGCGGUAAGAGU

UUUAGUCAGAGCAGUAAUCUGGUGCGCCAUCAGCGUACCCACACGGGUGAGAAACCAUAUAAGUGUCCGGAAUGCGGCAAGAG

UUUUAGCACCCAUCUGGAUCUGAUCCGUCAUCAGCGCACCCACACCGGUGAAAAACCAACCGGCAAGAAAACCAGUGCUAGCG

GCAGCGGCGGCGGCAGCGGCGGCAUCUUCAAGCCCGAGGAGCUGCGGCAGGCCCUGAUGCCCACCCUGGAGGCCCUGUACCGG

CAGGACCCCGAGAGCCUGCCCUUCCGGCAGCCCGUGGACCCCCAGCUGCUGGGCAUCCCCGACUACUUCGACAUCGUGAAAUC

CCCCAUGGACCUGAGCACCAUCAAGCGGAAGCUGGACACCGGCCAGUACCAGGAGCCCUGGCAGUACGUGGACGACAUCUGGC

UGAUGUUCAACAACGCCUGGCUGUACAACCGGAAAACCAGCCGGGUGUACAAGUACUGCAGCAAGCUGAGCGAGGUGUUCGAG

CAGGAGAUCGACCCCGUGAUGCAGAGCCUGGGCUACUGCUGCGGCCGGAAGCUGGAGUUCAGCCCCCAGACCCUGUGCUGCUA

CGGCAAGCAGCUGUGCACCAUCCCCCGGGACGCCACCUACUACAGCUACCAGAACCGGUACCACUUCUGCGAGAAGUGCUUCA

ACGAGAUCCAGGGCGAGAGCGUGACCUGGGCGACGACCCCAGCCAGCCCCAGACCACCAUCAACAAGGAGCAGUUCAGCAAG

CGGAAGAACGACACCCUGGACCCCGAGCUGUUCGUGGAGUGCACCGAGUGCGGCCGGAAGAUGCACCAGAUCUGCGUGCUGCA

CCACGAGAUCAUCUGGCCCGCCGGCUUCGUGUGCGACGGCUGCCUGAAGAAAUCCGCCCGGACCCGGAAGGAGAACAAGUUCA

GCGCCAAGCGGCUGCCCAGCACCCGGCUGGGCACCUUCCUGGAGAACCGGGUGAACGACUUCCUGCGGCGGCAGAACCACCCC

GAGAGCGGCGAGGUGACCGUGCGGGUGGUGCACGCCAGCGACAAGACCGUGGAGGUGAAGCCCGGCAUGAAGGCCCGGUUCGU

GGACAGCGGCGAGAUGGCCGAGAGCUUCCCCUACCGGACCAAGGCCCUGUUCGCCUUCGAGGAGAUCGACGGCGUGGACCUGU

GCUUCUUCGGCAUGCACGUGCAGGAGUACGGCAGCGACUGCCCCCCCCCCAACCAGCGGCGGGUGUACAUCAGCUACCUGGAC

AGCGUGCACUUCUUCCGGCCCAAGUGCCUGCGGACCGCCGUGUACCACGAGAUCCUGAUCGGCUACCUGGAGUACGUGAAGAA

GCUGGGCUACACCACCGGCCACAUCUGGGCCUGCCCCCCCAGCGAGGGCGACGACUACAUCUUCCACUGCCACCCCCCCGACC

AGAAGAUCCCCAAGCCCAAGCGGCUGCAGGAGUGGUACAAGAAGAUGCUGGACAAGGCCGUGAGCGAGCGGAUCGUGCACGAC

UACAAGGACAUCUUCAAGCAGGCCACCGAGGACCGGCUGACCAGCGCCAAGGAGCUGCCCUACUUCGAGGGCGACUUCUGGCC

CAACGUGCUGGAGGAGAGCAUCAAGGAGCUGGAGCAGGAGGAGGAGGAGCGGAAGCGGGAGGAGAACACCAGCAACGAGAGCA

CCGACGUGACCAAGGGCGACAGCAAGAACGCCAAGAAGAAGAACAACAAGAAAACCAGCAAGAACAAGAGCAGCCUGAGCCGG

GGCAACAAGAAGAAGCCCGGCAUGCCCAACGUGAGCAACGACCUGAGCCAGAAGCUGUACGCCACCAUGGAGAAGCACAAGGA

GGUGUUCUUCGUGAUCCGGCUGAUCGCCGGCCCCGCCGCCAACAGCCUGCCCCCAUCGUGGACCCCGACCCCCUGAUCCCCU

GCGACCUGAUGGACGGCCGGGACGCCUUCCUGACCCUGGCCCGGGACAAGCACCUGGAGUUCAGCAGCCUGCGGGGCCCCAG

UGGAGCACCAUGUGCAUGCUGGUGGAGCUGCACACCCAGAGCCAGGACAGCGGCGGCAAGCGGCCCGCCGCCACCAAGAAGGC

CGGCCAGGCCAAGAAGAAGAAGGGCAGCUACCCCUACGACGUGCCCGACUACGCCUGAGCGGCCGCUUAAUUAAGCUGCCUUC

UGCGGGGCUUGCCUUCUGGCCAUGCCCUUCUUCUCUCCCUUGCACCUGUACCUCUUGGUCUUUGAAUAAAGCCUGAGUAGGAA

GUCUAGAAAAAAAAAAAAAAAAAAAAAAAAAAAAAAAAAAAAAAAAAAAAAAAAAAAAAAAAAAAAAAAAAAAAAAAAAAAAA

AAA

>Nucleotide Seqeunce of DNA binding domain of ZF7-P300

SEQ ID NO.: 233

CUGGAACCGGGCGAGAAGCCAUACAAGUGCCCAGAGUGCGGCAAAAGCUUCAGCCGCAGCGACCAUCUGACCAAUCACCAACG

CACCCAUACCGGUGAGAAGCCGUACAAAUGCCCAGAGUGCGGUAAGAGCUUUAGUACCAGUGGCAGUCUGGUUCGUCAUCAGC

GCACGCACACGGGCGAAAAACCAUACAAAUGCCCGGAGUGCGGCAAAAGCUUUAGCCAAGCCGGUCAUCUGGCGAGCCAUCAA

CGUACGCACACCGGCGAGAAGCCGUAUAAUGUCCGGAGUGCGGUAAGAGCUUUAGCCGUAGCGAUAAACUGACCGAACACCA

ACGUACGCAUACGGGCGAGAAACCAUAUAAAUGUCCAGAGUGUGGCAAGAGUUUCAGCACCAGCGGCAAUCUGACCGAGCAUC

AACGUACCCAUACCGGUGAAAAGCCAUAUAAAUGUCCAGAAUGCGGUAAGAGUUUUAGUCAGAGCAGUAAUCUGGUGCGCCAU

CAGCGUACCCACACGGGUGAGAAACCAUAUAAGUGUCCGGAAUGCGGCAAGAGUUUUUAGCACCCAUCUGGAUCUGAUCCGUCA

UCAGCGCACCCACACCGGUGAAAAACCAACCGGCAAGAAAACCAGU

-continued

>ZF5.3-VPR3 protein

SEQ ID NO.: 170

MAPKKKRKVGIHGVPAAGSSGSLEPGEKPYKCPECGKSFSRSDHLTNHQRTHTGEKPYKCPECGKSFSTSGSLVRHQRTHTGE
KPYKCPECGKSFSQAGHLASHQRTHTGEKPYKCPECGKSFSRSDKLTEHQRTHTGEKPYKCPECGKSFSTSGNLTEHQRTHTG
EKPYKCPECGKSFSQSSNLVRHQRTHTGEKPYKCPECGKSFSTHLDLIRHQRTHTGEKPTGKKTSASGSGGGSGGDALDDFDL
DMLGSDALDDFDLDMLGSDALDDFDLDMLGSDALDDFDLDMLGSGSGSQYLPDTDDRHRIEEKRKRTYETFKSIMKKSPFSGP
TDPRPPPRRIAVPSRSSASVPKPAPQPYPFTSSLSTINYDEFPTMVFPSGQISQASALAPAPPQVLPQAPAPAPAPAMVSALA
QAPAPVPVLAPGPPQAVAPPAPKPTQAGEGTLSEALLQLQFDDEDLGALLGNSTDPAVFTDLASVDNSEFQQLLNQGIPVAPH
TTEPMLMEYPEAITRLVTGAQRPPDPAPAPLGAPGLPNGLLSGDEDFSSIADMDFSALLGSGSGSRDSREGMFLPKPEAGSAI
SDVFEGREVCQPKRIRPFHPPGSPWANRPLPASLAPTPTGPVHEPVGSLTPAPVPQPLDPAPAVTPEASHLLEDPDEETSQAV
KALREMADTVIPQKEEAAICGQMDLSHPPPRGHLDELTTTLESMTEDLNLDSPLTPELNEILDTFLNDECLLHAMHISTGLSI
FDTSLFGSGSGSDALDDFDLDMLGSDALDDFDLDMLGSDALDDFDLDMLGSDALDDFDLDMLGSGSGSQYLPDTDDRHRIEEK
RKRTYETFKSIMKKSPFSGPTDPRPPPRRIAVPSRSSASVPKPAPQPYPFTSSLSTINYDEFPTMVFPSGQISQASALAPAPP
QVLPQAPAPAPAPAMVSALAQAPAPVPVLAPGPPQAVAPPAPKPTQAGEGTLSEALLQLQFDDEDLGALLGNSTDPAVFTDLA
SVDNSEFQQLLNQGIPVAPHTTEPMLMEYPEAITRLVTGAQRPPDPAPAPLGAPGLPNGLLSGDEDFSSIADMDFSALLGSGS
GSRDSREGMFLPKPEAGSAISDVFEGREVCQPKRIRPFHPPGSPWANRPLPASLAPTPTGPVHEPVGSLTPAPVPQPLDPAPA
VTPEASHLLEDPDEETSQAVKALREMADTVIPQKEEAAICGQMDLSHPPPRGHLDELTTTLESMTEDLNLDSPLTPELNEILD
TFLNDECLLHAMHISTGLSIFDTSLFGSGSGSDALDDFDLDMLGSDALDDFDLDMLGSDALDDFDLDMLGSDALDDFDLDMLG
SGSGSQYLPDTDDRHRIEEKRKRTYETFKSIMKKSPFSGPTDPRPPPRRIAVPSRSSASVPKPAPQPYPFTSSLSTINYDEFP
TMVFPSGQISQASALAPAPPQVLPQAPAPAPAPAMVSALAQAPAPVPVLAPGPPQAVAPPAPKPTQAGEGTLSEALLQLQFDD
EDLGALLGNSTDPAVFTDLASVDNSEFQQLLNQGIPVAPHTTEPMLMEYPEAITRLVTGAQRPPDPAPAPLGAPGLPNGLLSG
DEDFSSIADMDFSALLGSGSGSRDSREGMFLPKPEAGSAISDVFEGREVCQPKRIRPFHPPGSPWANRPLPASLAPTPTGPVH
EPVGSLTPAPVPQPLDPAPAVTPEASHLLEDPDEETSQAVKALREMADTVIPQKEEAAICGQMDLSHPPPRGHLDELTTTLES
MTEDLNLDSPLTPELNEILDTFLNDECLLHAMHISTGLSIFDTSLFGSGSGSGGGSGKRPAATKKAGQAKKKKGSYPYDVPD
YA*

>ZF5.3-VPR3 mRNA

SEQ ID NO.: 171

AGGAAAUAAGAGAGAAAAGAAGAGUAAGAAGAAAUAUAAGAGCCACCAUGGCCCCCAAGAAGAAGCGCAAGGUCGGGAUCCAC
GGAGUCCCGGCAGCAGGAUCCUCAGGCUCACUGGAACCGGGGGAAAAACCCUACAAGUGCCCGGAAUGCGGCAAGAGCUUCUC
GCGGUCCGACCACCUGACCAACCACCAGAGAACACACACCGGCGAGAAGCCGUACAAGUGCCCCGAGUGCGGGAAGUCGUUCA
GCACCUCAGGAUCGCUGGUCCGCCACCAACGGACCCACACAGGAGAAAAGCCCUACAAGUGCCCGGAAUGCGGAAAGAGCUUC
AGCCAAGCCGGGCACCUGGCAUCACACCAGCGAACCCACACCGGAGAAAAACCGUACAAAUGCCCGGAGUGCGGCAAAUCCUU
CUCGCGCUCCGACAAGCUGACCGAACACCAAAGGACACACACCGGAGAGAAGCCCUACAAGUGCCCGGAAUGCGGAAAAUCGU
UCUCGACCUCGGGGAACCUGACCGAGCACCAACGCACCCACACCGGCGAAAAACCGUACAAAUGCCCGGAGUGCGGAAAGUCG
UUCUCACAAUCCUCCAACCUGGUCCGGCACCAAAGAACGCACACAGGGGAAAAGCCGUACAAGUGCCCCGAAUGCGGGAAAUC
CUUCAGCACCCACCUGGACCUCAUCCGGCACCAGAGGACCCACACCGGGGAGAAGCCGACCGGCAAAAAGACCUCAGCGAGCG
GAUCCGGAGGAGGAUCAGGGGGGGACGCCCUCGACGACUUCGAUCUGGACAUGCUGGGUAGCGACGCCCUGGAUGACUUCGAC
CUCGAUAUGCUGGGAUCCGACGCACUUGACGAUUUGACUUGGACAUGCUCGGCUCCGACGCUCUGGACGAUUUCGACCUUGA
CAUGCUUGGCUCCGGCUCAGGAUCCCAGUACCUCCCCGAUACCGACGACAGACACCGGAUCGAAGAAAAGCGCAAGCGCACCU
ACGAAACCUUCAAGUCGAUUAUGAAGAAGUCGCCUUUCUCCGGGCCGACUGAUCCUAGACCUCCACCAAGAAGAAUCGCGGUG
CCGUCCAGAUCGUCCGCGUCAGUGCCGAAACCAGCACCGCAGCCGUAUCCGUUCACUUCCUCCCUUUCCACCAUUAACUACGA
CGAAUUCCCCACGAUGGUGUUCCCUAGCGGACAGAUUUCGCAAGCCAGCGCUCUUGCUCCUGCGCCUCCUCAAGUGCUGCCUC

-continued

```
AGGCCCCUGCUCCUGCUCCUGCACCCGCCAUGGUGUCCGCCCUGGCUCAAGCUCCAGCCCCUGUGCCUGUCCUGGCCCCUGGA

CCACCUCAGGCAGUAGCACCUCCCGCUCCCAAGCCCACCCAAGCGGGAGAGGGCACUCUUUCCGAGGCCCUGCUGCAACUGCA

GUUCGACGACGAGGACCUGGGGGCACUUCUGGGAAAUAGCACCGAUCCGGCCGUGUUCACCGACCUGGCCAGCGUCGACAACU

CAGAGUUCCAGCAGCUCCUCAACCAAGGGAUUCCGGUGGCCCCUCACACACCGAGCCGAUGUUGAUGGAAUACCCGGAAGCC

AUCACCCGCCUAGUGACCGGAGCGCAAAGACCGCCUGACCCAGCUCCUGCCCCUUUGGGAGCCCCUGGAUUGCCCAACGGACU

CCUGUCCGGCGACGAGGAUUUCUCGUCCAUCGCCGAUAUGGACUUCUCGGCCCUGUUGGGUAGCGGUUCGGGUAGUCGCGAUA

GCCGGGAAGGAAUGUUCCUGCCGAAGCCUGAGGCCGGGUCUGCCAUUAGCGAUGUGUUUGAAGGACGGGAAGUCUGUCAGCCC

AAGCGGAUUCGCCCAUUCCACCCCCUGGAUCGCCUUGGGCCAACAGGCCACUCCCCGCUUCGCUUGCGCCGACUCCUACCGG

GCCAGUGCACGAACCUGUGGGAUCCCUGACUCCGGCUCCUGUGCCACAGCCUCUGGAUCCGGCUCCCGCUGUCACCCCUGAGG

CCUCACACCUUCUCGAGGACCCCGACGAAGAGACUUCCCAGGCCGUGAAAGCGCUCCGGGAGAUGGCGGACACUGUGAUCCCG

CAAAAGGAAGAAGCCGCGAUUUGCGGCCAGAUGGACCUGUCGCAUCCUCCACCACGCGGUCACCUCGAUGAACUGACAACUAC

CCUGGAGUCGAUGACCGAGGACCUGAACCUGGACUCCCCGCUGACUCCUGAGCUCAACGAAAUCCUGGACACUUUCCUGAACG

AUGAGUGCCUGCUGCACGCCAUGCACAUCUCCACUGGGCUGUCAAUCUUCGACACCAGCCUGUUCGGCUCCGGAUCCGGUUCC

GACGCACUGGACGAUUUUGACCUGGAUAUGUUGGGGAGCGACGCACUGGACGAUUUUGAUCUGGAUAUGCUGGGAUCCGACGC

GCUCGACGAUUUCGACCUGGACAUGCUCGAUCGGACGCCCUGGACGACUUCGACCUCGAUAUGCUUGGAUCAGGGUCCGGCU

CACAAUAUCUGCCGGACACUGAUGACCGGCAUAGAAUCGAAGAAAAGCGCAAGCGGACCUACGAAACUUUCAAGAGCAUCAUG

AAGAAAUCGCCGUUCUCUGGGCCGACUGAUCCUAGGCCGCCUCCGAGAAGGAUCGCCGUGCCCUCAAGAUCCUCCGCCUCUGU

GCCCAAGCCGGCUCCACAGCCUUACCCCUUCACUUCGUCGCUGAGCACCAUCAACUACGACGAAUUCCCGACCAUGGUCUUUC

CGAGCGGCCAGAUUUCCCAGGCGUCCGCCUUGGCUCCUGCACCACCCCAAGUGCUGCCUCAGGCGCCUGCACCAGCUCCAGCC

CCUGCCAUGGUGUCCGCGCUGGCACAAGCCCCUGCACCUGUGCCAGUGCUCGCACCUGGUCCUCCGCAAGCUGUGGCACCUCC

UGCGCCUAAGCCGACUCAGGCCGGAGAAGGGACCCUGUCAGAGGCCCUGCUGCAACUGCAGUUUGACGAUGAGGAUCUGGGAG

CCCUUCUGGGCAACUCGACUGACCCCGCCGUGUUCACCGACCUGGCGUCCGUGGAUAACUCCGAGUUCCAGCAGCUCCUCAAC

CAAGGGAUUCCUGUCGCCCCGCACACUACCGAGCCGAUGCUGAUGGAGUACCCGGAGGCCAUCACCCGGCUUGUGACGGGUGC

UCAGAGGCCUCCAGAUCCGGCUCCAGCACCGUUAGGAGCCCCCGGACUUCCUAACGGACUGCUGUCCGGCGACGAGGACUUCU

CCAGCAUCGCCGACAUGGAUUUUUCCGCGCUGUUGGGAUCGGGUUCCGGCUCAAGAGACAGCCGCGAGGGAAUGUUCCUCCCG

AAACCAGAGGCCGGCUCAGCCAUCAGCGACGUGUUCGAAGGGCGCGAAGUCUGCCAGCCCAAGCGGAUCCGCCCGUUUCAUCC

GCCUGGAUCACCGUGGGCCAACAGACCCCUACCCGCAAGCUUAGCCCCUACCCCCACUGGCCCUGUCCACGAACCUGUGGGCU

CCCUGACACCCGCUCCUGUGCCACAACCUCUGGACCCCGCACCAGCAGUCACACCCGAAGCCAGCCACCUCCUUGAGGAUCCG

GACGAGGAGACUAGCCAGGCCGUGAAGGCGCUCCGCGAAAUGGCCGACACUGUGAUCCCUCAAAAGGAAGAGGCGGCCAUUUG

UGGACAGAUGGACUUGUCCCACCCGCCUCCAAGAGGUCACCUGGACGAACUUACCACCACGCUCGAAUCCAUGACUGAGGAUC

UGAACCUGGAUUCCCCGCUCACUCCCGAGCUCAACGAAAUCCUUGAUACCUUCCUUAACGACGAGUGUCCUCGCAUGCCAUG

CACAUCUCCACCGGACUGAGCAUUUUCGACACCUCGCUGUUCGGUUCCGGAAGCGGCUCAGACGCGCUGGAUGACUUCGAUUU

GGACAUGCUUGGCAGCGAUGCCCGGAUGAUUUCGACCUGGACAUGCUCGGGUCGGAUGCGCUGGACGACUUCGAUCUCGAUA

UGUUGGGCUCCGAUGCCCUCGACGACUUUGACCUCGACAUGCUGGGCUCGGGCUCAGGAUCCCAAUACCUCCCGGAUACCGAC

GACAGGCAUCGCAUUGAGGAAAAGCGGAAGCGCACCUAUGAAACCUUCAAGUCCAUUAUGAAGAAGUCGCCCUUUCCGGACC

GACUGACCCUCGGCCUCCUCCUCGACGAAUUGCCGUCCCAUCUCGGUCAUCCGCUCGGUCCCCAAGCCAGCACCGCAGCCUU

AUCCGUUCACCUCCUCUCUGUCCACCAUUAACUACGAUGAAUUCCCCACCAUGGUGUUCCCGUCGGGACAGAUCUCCCAAGCC

UCAGCCCUUGCUCCUGCCCCUCCACAAGUCCUGCCCAAGCACCAGCGCCUGCUCCUGCACCCGCGAUGGUGUCCGCACUGGC

GCAAGCUCCUGCCCCUGUGCCUGUGCUGGCUCCUGGACCACCCCAGGCAGUAGCACCUCCAGCCCCGAAGCCCACUCAGGCUG

GAGAGGGAACCCUGAGCGAAGCGCUGCUGCAGCUCCAGUUCGACGACGAAGAUCUGGGUGCCCUGCUGGGAAAUUCCACCGAU

CCGGCGGUGUUCACAGACCUGGCCUCCGUGGACAACUCCGAAUUCCAGCAGUUGUUGAACCAGGGCAUUCCUGUGGCCCCCCA
```

```
CACCACUGAGCCAAUGCUCAUGGAAUACCCCGAGGCCAUUACCAGACUCGUGACCGGAGCCCAAAGGCCUCCGGAUCCAGCGC

CAGCUCCGUUGGGAGCUCCGGGAUUGCCGAACGGGCUGCUGUCGGGAGAUGAAGAUUUCUCCUCAAUCGCCGAUAUGGACUUC

UCCGCGCUGCUGGGUUCGGGUUCGGGAUCGCGCGAUAGCCGGGAGGGCAUGUUCCUACCGAAGCCUGAGGCCGGAAGCGCCAU

CUCCGAUGUGUUCGAGGGCAGAGAAGUCUGUCAGCCUAAGCGCAUUCGCCCGUUCCACCCUCCUGGAUCGCCCUGGGCCAAUC

GGCCACUGCCUGCGUCCCUCGCUCCAACGCCGACCGGACCUGUGCACGAACCGGUCGGCUCACUGACUCCAGCUCCCGUCCCA

CAACCGCUCGACCCUGCUCCCGCUGUUACCCCCGAAGCCUCCCAUUUGCUGGAAGAUCCCGAUGAGGAAACUUCCCAGGCCGU

CAAGGCCCUGCGGGAGAUGGCAGACACCGUGAUACCCCAGAAGGAAGAAGCUGCCAUCUGCGGGCAGAUGGACCUGUCCCAUC

CUCCUCCACGCGGACACUUGGACGAGCUGACCACUACUCUGGAGUCCAUGACCGAGGACCUGAACCUUGACUCGCCUUUGACC

CCUGAACUGAACGAAAUUCUGGACACCUUCCUGAAUGACGAGUGCCUCCUGCACGCGAUGCACAUCAGCACCGGACUGUCCAU

CUUCGACACUUCCCUCUUUGGGAGCGGGUCCGGAUCAGGCGGUGGUGUAGCGGGAAACGGCCAGCAGCGACCAAGAAGGCCG

GACAGGCCAAGAAGAAGAAAGGCUCAUACCCCUACGACGUGCCGGACUACGCAUGAGCGGCCGCUUAAUUAAGCUGCCUUCUG

CGGGGCUUGCCUUCUGGCCAUGCCCUUCUUCUCUCCCUUGCACCUGUACCUCUUGGUCUUUGAAUAAAGCCUGAGUAGGAAGU

CUAGAAAAAAAAAAAAAAAAAAAAAAAAAAAAAAAAAAAAAAAAAAAAAAAAAAAAAAAAAAAAAAAAAAAAAAAAAAAAAAA

AAAAAAAAAAAAAAAAAAAAAAAAAAAAAAAA
```

>Nucleotide Seqeunce of DNA binding domain of ZF5.3-VPR3

SEQ ID NO.: 234

```
CUGGAACCGGGGGAAAAACCCUACAAGUGCCCGGAAUGCGGCAAGAGCUUCUCGCGGUCCGACCACCUGACCAACCACCAGAG

AACACACACCGGCGAGAAGCCGUACAAGUGCCCCGAGUGCGGGAAGUCGUUCAGCACCUCAGGAUCGCUGGUCCGCCACCAAC

GGACCCACACAGGAGAAAAGCCCUACAAGUGCCCGGAAUGCGGGAAAGAGCUUCAGCCAAGCCGGGCACCUGGCAUCACACCAG

CGAACCCACACCGGAGAAAAACCGUACAAAUGCCCGGAGUGCGGCAAAUCCUUCUCGCGCUCCGACAAGCUGACCGAACACCA

AAGGACACACACCGGAGAGAAGCCCUACAAGUGCCCGGAAUGCGGAAAAUCGUUCUCGACCUCGGGGAACCUGACCGAGCACC

AACGCACCCACACCGGCGAAAAACCGUACAAAUGCCCGGAGUGCGGAAAGUCGUUCUCACAAUCCUCCAACCUGGUCCGGCAC

CAAAGAACGCACACAGGGGAAAAGCCGUACAAGUGCCCCGAAUGCGGGAAAUCCUUCAGCACCCACCUGGACCUCAUCCGGCA

CCAGAGGACCCACACCGGGGAGAAGCCGACCGGCAAAAAGACCUCA
```

>dCas9-VPR3 protein

SEQ ID NO.: 172

MAPKKKRKVGIHGVPAADKKYSIGLAIGTNSVGWAVITDEYKVPSKKFKVLGNTDRHSIKKNLIGALLFDSGETAEATRLKRT

ARRRYTRRKNRICYLQEIFSNEMAKVDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDAKAILSARLSKSRRLENLIAQLPGEK

KNGLFGNLIALSLGLTPNFKSNFDLAEDAKLQLSKDTYDDDLDNLLAQIGDQYADLFLAAKNLSDAILLSDILRVNTEITKAP

LSASMIKRYDEHHQDLTLLKALVRQQLPEKYKEIFFDQSKNGYAGYIDGGASQEEFYKFIKPILEKMDGTEELLVKLNREDLL

RKQRTFDNGSIPHQIHLGELHAILRRQEDFYPFLKDNREKIEKILTFRIPYYVGPLARGNSRFAWMTRKSEETITPWNFEEVV

DKGASAQSFIERMTNFDKNLPNEKVLPKHSLLYEYFTVYNELTKVKYVTEGMRKPAFLSGEQKKAIVDLLFKTNRKVTVKQLK

EDYFKKIECFDSVEISGVEDRFNASLGTYHDLLKIIKDKDFLDNEENEDILEDIVLTLTLFEDREMIEERLKTYAHLFDDKVM

KQLKRRRYTGWGRLSRKLINGIRDKQSGKTILDFLKSDGFANRNFMQLIHDDSLTFKEDIQKAQVSGQGDSLHEHIANLAGSP

AIKKGILQTVKVVDELVKVMGRHKPENIVIEMARENQTTQKGQKNSRERMKRIEEGIKELGSQILKEHPVENTQLQNEKLYLY

YLQNGRDMYVDQELDINRLSDYDVAAIVPQSFLKDDSIDNKVLTRSDKARGKSDNVPSEEVVKKMKNYWRQLLNAKLITQRKF

DNLTKAERGGLSELDKAGFIKRQLVETRQITKHVAQILDSRMNTKYDENDKLIREVKVITLKSKLVSDFRKDFQFYKVREINN

YHHAHDAYLNAVVGTALIKKYPKLESEFVYGDYKVYDVRKMIAKSEQEIGKATAKYFFYSNIMNFFKTEITLANGEIRKRPLI

ETNGETGEIVWDKGRDFATVRKVLSMPQVNIVKKTEVQTGGFSKESILPKRNSDKLIARKKDWDPKKYGGFDSPTVAYSVLVV

AKVEKGKSKKLKSVKELLGITIMERSSFEKNPIDFLEAKGYKEVKKDLIIKLPKYSLFELENGRKRMLASAGELQKGNELALP

SKYVNFLYLASHYEKLKGSPEDNEQKQLFVEQHKHYLDEIIEQISEFSKRVILADANLDKVLSAYNKHRDKPIREQAENIIHL

-continued

FTLTNLGAPAAFKYFDTTIDRKYTSTKEVLDATLIHQSITGLYETRIDLSQLGGDSGGKRPAATKKAGQAKKKKSGGGGSDA

LDDFDLDMLGSDALDDFDLDMLGSDALDDFDLDMLGSDALDDFDLDMLGSGSGSQYLPDTDDRHRIEEKRKRTYETFKSIMKK

SPFSGPTDPRPPPRRIAVPSRSSASVPKPAPQPYPFTSSLSTINYDEFPTMVFPSGQISQASALAPAPPQVLPQAPAPAPAPA

MVSALAQAPAPVPVLAPGPPQAVAPPAPKPTQAGEGTLSEALLQLQFDDEDLGALLGNSTDPAVFTDLASVDNSEFQQLLNQG

IPVAPHTTEPMLMEYPEAITRLVTGAQRPPDPAPAPLGAPGLPNGLLSGDEDFSSIADMDFSALLGSGSGSRDSREGMFLPKP

EAGSAISDVFEGREVCQPKRIRPFHPPGSPWANRPLPASLAPTPTGPVHEPVGSLTPAPVPQPLDPAPAVTPEASHLLEDPDE

ETSQAVKALREMADTVIPQKEEAAICGQMDLSHPPPRGHLDELTTTLESMTEDLNLDSPLTPELNEILDTFLNDECLLHAMHI

STGLSIFDTSLFGSGSGSDALDDFDLDMLGSDALDDFDLDMLGSDALDDFDLDMLGSDALDDFDLDMLGSGSGSQYLPDTDDR

HRIEEKRKRTYETFKSIMKKSPFSGPTDPRPPPRRIAVPSRSSASVPKPAPQPYPFTSSLSTINYDEFPTMVFPSGQISQASA

LAPAPPQVLPQAPAPAPAPAMVSALAQAPAPVPVLAPGPPQAVAPPAPKPTQAGEGTLSEALLQLQFDDEDLGALLGNSTDPA

VFTDLASVDNSEFQQLLNQGIPVAPHTTEPMLMEYPEAITRLVTGAQRPPDPAPAPLGAPGLPNGLLSGDEDFSSIADMDFSA

LLGSGSGSRDSREGMFLPKPEAGSAISDVFEGREVCQPKRIRPFHPPGSPWANRPLPASLAPTPTGPVHEPVGSLTPAPVPQP

LDPAPAVTPEASHLLEDPDEETSQAVKALREMADTVIPQKEEAAICGQMDLSHPPPRGHLDELTTTLESMTEDLNLDSPLTPE

LNEILDTFLNDECLLHAMHISTGLSIFDTSLFGSGSGSDALDDFDLDMLGSDALDDFDLDMLGSDALDDFDLDMLGSDALDDF

DLDMLGSGSGSQYLPDTDDRHRIEEKRKRTYETFKSIMKKSPFSGPTDPRPPPRRIAVPSRSSASVPKPAPQPYPFTSSLSTI

NYDEFPTMVFPSGQISQASALAPAPPQVLPQAPAPAPAPAMVSALAQAPAPVPVLAPGPPQAVAPPAPKPTQAGEGTLSEALL

QLQFDDEDLGALLGNSTDPAVFTDLASVDNSEFQQLLNQGIPVAPHTTEPMLMEYPEAITRLVTGAQRPPDPAPAPLGAPGLP

NGLLSGDEDFSSIADMDFSALLGSGSGSRDSREGMFLPKPEAGSAISDVFEGREVCQPKRIRPFHPPGSPWANRPLPASLAPT

PTGPVHEPVGSLTPAPVPQPLDPAPAVTPEASHLLEDPDEETSQAVKALREMADTVIPQKEEAAICGQMDLSHPPPRGHLDEL

TTTLESMTEDLNLDSPLTPELNEILDTFLNDECLLHAMHISTGLSIFDTSLFGSGSGSGGGGSGKRPAATKKAGQAKKKKGSY

PYDVPDYA*

>dCas9-VPR3 mRNA

SEQ ID NO. 173

AGGAAAUAAGAGAGAAAAGAAGAGUAAGAAGAAAUAUAAGAGCCACCAUGGCCCCCAAGAAGAAGAGGAAAGUCGGAAUUCAC

GGAGUGCCUGCAGCGGAUAAGAAGUACUCCAUCGGACUCGCAAUCGGCACCAACUCCGUGGGAUGGGCCGUGAUCACCGACGA

GUACAAAGUGCCGUCUAAAAAGUUCAAGGUGCUCGGAAACACCGAUAGGCACUCCAUCAAGAAGAACCUGAUUGGGGCCCUGC

UGUUUGAUUCCGGGGAAACGGCAGAGGCCACUCGCCUCAAGAGAACUGCACGCCGGCGGUACACUCGUCGGAAGAACCGCAUC

UGCUAUCUGCAAGAGAUUUUCUCCAACGAGAUGGCCAAAGUGGACGACAUUCUUCCACCGCCUCGAAGAAUCUUUCCUGGU

CGAAGAGGACAAGAAGCACGAACGCCACCCCAUUUUCGGGAACAUUGUCGACGAAGUGGCGUACCACGAGAAGUACCCCACCA

UCUACCAUCUCCGCAAGAAGCUCGUGGAUUCCACUGACAAGGCCGAUCUCAGACUGAUCUACCUGGCGCUUGCUCACAUGAUU

AAGUUCAGGGGUCACUUCCUGAUUGAGGGAGAUCUGAACCCCGACAACAGCGAUGUCGAUAAGCUGUUCAUUCAGCUGGUGCA

GACCUACAAUCAGCUGUUCGAAGAGAACCCCAUUAAUGCCUCCGGUGUCGAUGCCAAGGCCAUCCUGUCCGCACGGCUGAGCA

AAUCGCGCAGGCUGGAAAACCUGAUCGCCCAGCUGCCGGAGAGAAAAGAACGGACUGUUCGGCAACCUUAUCGCGCUGUCC

UUGGGACUGACCCCGAACUUCAAGAGCAACUUCGACUUGGCCGAGGAUGCCAAGCUGCAACUGUCGAAGGACACCUACGACGA

UGACCUCGAUAAUCUGCUGGCCCAAAUUGGCGAUCAAUAUGCAGACCUGUUCCUUGCCGAAAGAACCUGAGCGACGCGAUUC

UCCUGCUCGGACAUCCUGCGGGUCAACACCGAGAUCACCAAGGCACCGUUGUCCGCCUCCAUGAUUAAGCGAUACGACGAACAC

CAUCAGGACCUGACUCUGCUGAAGGCCCUGGUCCGCCAACAGCUGCCCGAGAAGUACAAGGAGAUCUUCUUCGACCAAUCCAA

GAAUGGAUACGCUGGAUACAUCGAUGGCGGUGCCAGCCAAGAGGAAUUCUACAAGUUCAUCAAACCGAUACUGGAGAAGAUGG

ACGGCACAGAGGAACUCCUGGUCAAGCUGAACCGGGAGGAUCUGCUGCGGAAGCAGAGGACCUUCGACAACGGGUCCAUCCCG

CACCAGAUUCACCUGGGCGAACUGCAUGCGAUCCUGCGACGGCAGGAGGACUUCUACCCAUUCCUGAAGGAUAACAGAGAGAA

AAUCGAGAAGAUCCUCACCUUCCGGAUCCCGUAUUACGUGGGACCCCUGGCUAGGGGCAACAGCCGCUUCGCCUGGAUGACCC

GCAAGUCCGAGGAAACUAUUACUCCCUGGAACUUCGAGGAAGUAGUGGACAAAGGCGCCAGCGCGCAAUCCUUCAUCGAACGG

-continued

```
AUGACCAACUUCGACAAGAACUUGCCGAACGAAAAGGUGUUGCCGAAGCAUUCUCUGCUGUAUGAGUACUUCACUGUGUACAA

CGAACUGACCAAAGUGAAAUACGUCACAGAAGGAAUGAGAAAGCCAGCCUUCCUUAGCGGGGAGCAGAAGAAGGCCAUUGUGG

ACCUCCUGUUCAAAACCAACCGAAAGGUCACCGUGAAGCAACUGAAGGAGGAUUACUUCAAGAAGAUCGAAUGUUUCGACUCG

GUGGAGAUCUCCGGGGUGGAGGAUCGCUUCAAUGCCUCCCUGGGCACCUACCAUGAUCUGCUCAAGAUCAUCAAGGAUAAGGA

CUUCCUCGACAACGAAGAGAACGAAGAUAUCCGGAGGAUAUCGUGCUCACCCUCACCCUGUUCGAGGAUAGAGAGAUGAUCG

AAGAGAGACUUAAGACCUACGCCCACCUGUUCGACGACAAAGUCAUGAAGCAGCUGAAGCGGAGGAGGUACACUGGAUGGGGC

AGACUGUCCCGCAAGCUCAUCAACGGGAUUCGAGAUAAGCAGUCCGGAAAGACAAUCCUCGACUUCCUGAAAUCCGACGGAUU

UGCCAACAGAAACUUCAUGCAGCUGAUCCAUGAUGACUCGCUGACCUUCAAGGAGGAUAUUCAGAAGGCUCAAGUGUCGGGAC

AGGGCGAUUCCCUCCACGAGCACAUCGCCAACCUCGCGGGAUCCCCUGCAAUCAAGAAGGGUAUCCUGCAGACCGUGAAGGUC

GUGGACGAAUUAGUGAAAGUCAUGGGCCGGCAUAAGCCUGAAAACAUCGUGAUCGAGAUGGCCCGGGAAAACCAGACCACCCA

AAAGGGACAGAAGAACUCCCGCGAGCGCAUGAAGCGGAUCGAGGAAGGGAUCAAGGAGCUGGGGUCGCAGAUCUUAAAGGAGC

ACCCCGUGGAAAAUACUCAGCUGCAAAACGAAAAGCUGUACCUGUAUUACUUGCAAAACGGAAGAGAUAUGUACGUGGAUCAA

GAAUUGGACAUCAACAGACUCUCCGACUACGACGUCGCUGCGAUUGUGCCACAAAGCUUUCUUAAGGACGACUCCAUCGACAA

CAAGGUCCUCACCCGGUCCGAUAAGGCCCGCGGAAAGUCCGACAACGUGCCAAGCGAAGAGGUGGUCAAGAAGAUGAAGAAUU

ACUGGCGGCAGCUGCUGAACGCCAAGCUGAUAACUCAGCGGAAGUUCGACAACCUGACUAAGGCUGAGCGGGGAGGACUCUCG

GAACUGGACAAGGCUGGGUUCAUCAAGAGACAGUUGGUGGAAACCCGCCAAAUUACCAAACACGUGGCGCAGAUCCUGGACUC

ACGCAUGAACACUAAGUACGACGAGAACGAUAAGCUGAUUCGGGAAGUCAAGUGAUCACCCUGAAGUCCAAGCUCGUCAGCG

ACUUCCGGAAGGAUUUCCAGUUUUACAAGGUCCGCGAAAUUAACAACUACCAUCAUGCUCACGACGCCUACUUGAACGCCGUG

GUCGGUACCGCCCUGAUCAAGAAGUAUCCAAAGCUCGAGUCCGAGUUUGUGUACGGCGACUACAAGGUCUACGACGUGCGCAA

GAUGAUCGCGAAAUCCGAGCAGGAAAUCGAAAAGGCCACCGCCAAGUACUUCUUCUACUCAAACAUUAUGAACUUCUUCAAGA

CCGAAAUCACUCUGGCGAACGGCGAAAUCCGGAAAAGACCGCUGAUCGAGACUAACGGCGAAACCGGCGAAAUCGUGUGGGAC

AAGGGACGGACUUCGCCACCGUGCGCAAGGUGCUGUCGAUGCCCCAAGUGAACAUUGUGAAGAAAACCGAAGUCCAGACUGG

CGGCUUCAGCAAAGAAUCGAUCCUGCCCAAGAGAAACAGCGACAAGCUGAUCGCCCGCAAGAAGGACUGGGACCCCAAGAAAU

ACGGCGGUUUCGACUCACCCACUGUGGCCUACUCGGUCCUCGUGGUCGCCAAGGUCGAGAAGGGCAAAAGCAAAAGCUUAAA

UCGGUGAAGGAACUUCUGGGGUAUCACGAUCAUGGAACGCUCCUCCUUCGAAAAGAACCCCAUCGACUUUUUGGAAGCAAAGGG

AUACAAGGAAGUCAAGAAGGACCUCAUCAUCAAGCUGCCGAAGUAUAGCCUCUUCGAACUGGAGAACGGUCGGAAGAGAAUGC

UGGCUUCAGCGGGAGAGCUGCAAAAGGGAAACGAGCUGGCCCUUCCGAGCAAAUACGUCAACUUUCUGUACCUGGCCUCGCAC

UACGAAAAGCUCAAGGGAUCACCCGAGGACAACGAACAGAAGCAACUGUUCGUGGAACAGCAUAAGCAUUACCUGGAUGAGAU

UAUCGAACAGAUUUCCGAAUUCUCCAAGCGCGUGAUUCUGGCCGACGCCAACCUGGACAAGGUCCUUUCAGCCUACAACAAGC

ACCGGGAUAAGCCGAUCCGGGAACAGGCGGAAAACAUCAUCCAUCUGUUCACGUUGACUAAUCUUGGAGCACCAGCCGCGUUU

AAGUACUUUGACACCACCAUUGACAGGAAACGGUACACAUCCACGAAGGAAGUGUUGGAUGCGACGCUGAUUCAUCAGAGUAU

CACCGGACUCUACGAAACGCGGAUUGACCUCAGCCAGUUGGGAGGGACUCCGGAGGAAAGAGGCCAGCCGCCACUAAGAAGG

CUGGGCAGGCCAAGAAGAAAAGUCCGGUGGAGGAGGCUCAGACGCCCUCGACGACUUCGAUCUGGACAUGCUGGGUAGCGAC

GCCCUGGAUGACUUCGACCUCGAUAUGCUGGGAUCCGACGCACUUGACGAUUUUGACUUGGACAUGCUCGGCUCCGACGCUCU

GGACGAUUUCGACCUUGACAUGCUUGGCUCCGGCUCAGGAUCCCAGUACCUCCCCGAUACCGACGACAGACACCGGAUCGAAG

AAAAGCGCAAGCGCACCUACGAAACCUUCAAGUCGAUUAUGAAGAAGUCGCCUUUCUCCGGGCCGACUGAUCCUAGACCUCCA

CCAAGAAGAAUCGCGGUGCCGUCCAGAUCGUCCGCGUCAGUGCCGAAACCAGCACCGCAGCCGUAUCCGUUCACUUCCUCCCU

UUCCACCAUUAACUACGACGAAUUCCCCACGAUGGUGUUCCCUAGCGGACAGAUUUCGCAAGCCAGCGCUCUUGCUCCUGCGC

CUCCUCAAGUGCUGCCUCAGGCCCCUGCUCCUGCUCCUGCACCCGCCAUGGUGUCCGCCCUGGCUCAAGCUCCAGCCCCUGUG

CCUGUCCUGGCCCCUGGACCACCUCAGGCAGUAGCACCUCCCGCUCCCAAGCCCACCCAAGCGGGAGAGGGCACUCUUUCCGA
```

-continued

```
GGCCCUGCUGCAACUGCAGUUCGACGACGAGGACCUGGGGGCACUUCUGGGAAAUAGCACCGAUCCGGCCGUGUUCACCGACC
UGGCCAGCGUCGACAACUCAGAGUUCCAGCAGCUCCUCAACCAAGGGAUUCCGGUGGCCCCUCACACGACCGAGCCGAUGUUG
AUGGAAUACCCGGAAGCCAUCACCCGCCUAGUGACCGGAGCGCAAAGACCGCCUGACCCAGCUCCUGCCCCUUUGGGAGCCCC
UGGAUUGCCCAACGGACUCCUGUCCGGCGACGAGGAUUUCUCGUCCAUCGCCGAUAUGGACUUCUCGGCCCUGUUGGGUAGCG
GUUCGGGUAGUCGCGAUAGCCGGGAAGGAAUGUUCCUGCCGAAGCCUGAGGCCGGGUCUGCCAUUAGCGAUGUGUUUGAAGGA
CGGGAAGUCUGUCAGCCCAAGCGGAUUCGCCCAUUCCACCCCCCUGGAUCGCCUUGGGCCAACAGGCCACUCCCCGCUUCGCU
UGCGCCGACUCCUACCGGGCCAGUGCACGAACCUGUGGGAUCCCUGACUCCGGCUCCUGUGCCACAGCCUCUGGAUCCGGCUC
CCGCUGUCACCCCUGAGGCCUCACACCUUCUCGAGGACCCCGACGAAGAGACUUCCCAGGCCGUGAAAGCGCUCCGGGAGAUG
GCGGACACUGUGAUCCCGCAAAAGGAAGAAGCCGCGAUUUGCGGCCAGAUGGACCUGUCGCAUCCUCCACCACGCGGUCACCU
CGAUGAACUGACAACUACCCUGGAGUCGAUGACCGAGGACCUGAACCUGGACUCCCCGCUGACUCCUGAGCUCAACGAAAUCC
UGGACACUUUCCUGAACGAUGAGUGCCUGCUGCACGCCAUGCACAUCUCCACUGGGCUGUCAAUCUUCGACACCAGCCUGUUC
GGCUCCGGAUCCGGUUCCGACGCACUGGACGAUUUUGACCUGGAUAUGUUGGGGAGCGACGCACUGGACGAUUUUGAUCUGGA
UAUGCUGGGAUCCGACGCGCUCGACGAUUUCGACCUGGACAUGCUCGGAUCGGACGCCCUGGACGACUUCGACCUCGAUAUGC
UUGGAUCAGGGUCCGGCUCACAAUAUCUGCCGGACACUGAUGACCGGCAUAGAAUCGAAGAAAAGCGCAAGCGGACCUACGAA
ACUUUCAAGAGCAUCAUGAAGAAAUCGCCGUUCUCUGGGCCGACUGAUCCUAGGCCGCCUCCGAGAAGGAUCGCCGUGCCCUC
AAGAUCCUCCGCCUCUGUGCCCAAGCCGGCUCCACAGCCUUACCCCUUCACUUCGUCGCUGAGCACCAUCAACUACGACGAAU
UCCCGACCAUGGUCUUUCCGAGCGGCCAGAUUUCCCAGGCGUCCGCCUUGGCUCCUGCACCACCCCAAGUGCUGCCUCAGGCG
CCUGCACCAGCUCCAGCCCCUGCCAUGGUGUCCGCGCUGGCACAAGCCCCUGCACCUGUGCCAGUGCUCGCACCUGGUCCUCC
GCAAGCUGUGGCACCUCCUGCGCCUAAGCCGACUCAGGCCGGAGAAGGGACCCUGUCAGAGGCCCUGCUGCAACUGCAGUUUG
ACGAUGAGGAUCUGGGAGCCCUUCUGGGCAACUCGACUGACCCCGCCGUGUUCACCGACCUGGCGUCCGUGGAUAACUCCGAG
UUCCAGCAGCUCCUCAACCAAGGGAUUCCUGUCGCCCCGCACACUACCGAGCCGAUGCUGAUGGAGUACCCGGAGGCCAUCAC
CCGGCUUGUGACGGGUGCUCAGAGGCCUCCAGAUCCGGCUCCAGCACCGUUAGGAGCCCCCGGACUUCCUAACGGACUGCUGU
CCGGCGACGAGGACUUCUCCAGCAUCGCCGACAUGGAUUUUUCCGCUGUUGGGAUCGGGUUCCGGCUCAAGAGACAGCCGC
GAGGGAAUGUUCCUCCCGAAACCAGAGGCCGGCUCAGCCAUCAGCGACGUGUUCGAAGGGCGCGAAGUCUGCCAGCCCAAGCG
GAUCCGCCCGUUUCAUCCGCCUGGAUCACCGUGGGCCAACAGACCCCUACCCGCAAGCUUAGCCCCUACCCCCACUGGCCCUG
UCCACGAACCUGUGGGCUCCCUGACACCCGCUCCUGUGCCACAACCUCUGGACCCCGCACCAGCAGUCACACCCGAAGCCAGC
CACCUCCUUGAGGAUCCGGACGAGGAGACUAGCCAGGCCGUGAAGGCGCUCCGCGAAAUGGCCGACACUGUGAUCCCUCAAAA
GGAAGAGGCGGCCAUUUGUGGACAGAUGGACUUGUCCCACCCGCCUCCAAGAGGUCACCUGGACGAACUUACCACCACGCUCG
AAUCCAUGACUGAGGAUCUGAACCUGGAUUCCCCGCUCACUCCCGAGCUCAACGAAAUCCUUGAUACCUUCCUUAACGACGAG
UGUCUCCUGCAUGCCAUGCACAUCUCCACCGGACUGAGCAUUUUCGACACCUCGCUGUUCGGUUCCGGAAGCGGCUCAGACGC
GCUGGAUGACUUCGAUUUGGACAUGCUUGGCAGCGAUGCCCUGGAUGAUUUCGACCUGGACAUGCUCGGGUCGGAUGCGCUGG
ACGACUUCGAUCUCGAUAUGUUGGGCUCCGAUGCCCUCGACGACUUUGACCUCGACAUGCUGGGCUCGGGCUCAGGAUCCCAA
UACCUCCCGGAUACCGACGACAGGCAUCGCAUUGAGGAAAAGCGGAAGCGCACCUAUGAAACCUUCAAGUCCAUUAUGAAGAA
GUCGCCCUUUCCGGACCGACUGACCCUCGGCCUCCUCCUCGACGAAUUGCCGUCCCAUCUCGGUCAUCCGCCUCGGUCCCCA
AGCCAGCACCGCAGCCUUAUCCGUUCACCUCCUCUCUGUCCACCAUUAACUACGAUGAAUUCCCACCAUGGUGUUCCCGUCG
GGACAGAUCUCCCAAGCCUCAGCCCUUGCUCCUGCCCCUCCACAAGUCCUGCCCAAGCACCAGCGCCUGCUCCUGCACCCGC
GAUGGUGUCCGCACUGGCGCAAGCUCCUGCCCCGUGCCUGUGCUGGCUCCUGGACCACCCCAGGCAGUAGCACCUCCAGCCC
CGAAGCCCACUCAGGCUGGAGAGGGAACCCUGAGCGAAGCGCUGCUGCAGCUCCAGUUCGACGACGAAGAUCUGGGUGCCCUG
CUGGGAAAUUCCACCGAUCCGGCGGUGUUCACAGACCUGGCCUCCGUGGACAACUCCGAAUUCCAGCAGUUGUUGAACCAGGG
CAUUCCUGUGGCCCCCCACACCACUGAGCCAAUGCUCAUGGAAUACCCCGAGGCCAUUACCAGACUCGUGACCGGAGCCCAAA
GGCCUCCGGAUCCAGCGCCAGCUCCGUUGGAGCUCCGGGAUUGCCGAACGGGCUGCUGUCGGGAGAUGAAGAUUUCUCCUCA
```

-continued

AUCGCCGAUAUGGACUUCUCCGCGCUGCUGGGUUCGGGUUCGGGAUCGCGCGAUAGCCGGGAGGGCAUGUUCCUACCGAAGCC

UGAGGCCGGAAGCGCCAUCUCCGAUGUGUUCGAGGGCAGAGAAGUCUGUCAGCCUAAGCGCAUUCGCCCGUUCCACCCUCCUG

GAUCGCCCUGGGCCAAUCGGCCACUGCCUGCGUCCCUCGCUCCAACGCCGACCGGACCUGUGCACGAACCGGUCGGCUCACUG

ACUCCAGCUCCCGUCCCACAACCGCUCGACCCUGCUCCCGCUGUUACCCCCGAAGCCUCCCAUUUGCUGGAAGAUCCCGAUGA

GGAAACUUCCCAGGCCGUCAAGGCCCUGCGGGAGAUGGCAGACACCGUGAUACCCCAGAAGGAAGAAGCUGCCAUCUGCGGGC

AGAUGGACCUGUCCCAUCCUCCUCCACGCGGACACUUGGACGAGCUGACCACUACUCUGGAGUCCAUGACCGAGGACCUGAAC

CUUGACUCGCCUUUGACCCCUGAACUGAACGAAAUUCUGGACACCUUCCUGAAUGACGAGUGCCUCCUGCACGCGAUGCACAU

CAGCACCGGACUGUCCAUCUUCGACACUUCCCUCUUUGGGAGCGGGUCCGGAUCAGGCGGUGGUGGUAGCGGGAAACGGCCAG

CAGCGACCAAGAAGGCCGGACAGGCCAAGAAGAAGAAAGGCUCAUACCCCUACGACGUGCCGGACUACGCAUGAGCGGCCGCU

UAAUUAAGCUGCCUUCUGCGGGGCUUGCCUUCUGGCCAUGCCCUUCUUCUCUCCCUUGCACCUGUACCUCUUGGUCUUUGAAU

AAAGCCUGAGUAGGAAGUCUAGAAAAAAAAAAAAAAAAAAAAAAAAAAAAAAAAAAAAAAAAAAAAAAAAAAAAAAAAAAAAA

AAAAAAAAAAAAAAAAAAAAAAAAAAAAAAAAAAAAAAAAAAAAA

>ZF5 protein-no effector

SEQ ID NO.: 174

MAPKKKRKVGIHGVPAAGSSGSLEPGEKPYKCPECGKSFSTSGNLTEHQRTHTGEKPYKCPECGKSFSDSGNLRVHQRTHTGE

KPYKCPECGKSFSHKNALQNHQRTHTGEKPYKCPECGKSFSRNDTLTEHQRTHTGEKPYKCPECGKSFSQRAHLERHQRTHTG

EKPYKCPECGKSFSRSDKLVRHQRTHTGEKPYKCPECGKSFSDPGHLVRHQRTHTGEKPTGKKTSASSGGKRPAATKKAGQAK

KKKGSYPYDVPDYA

>Nucleotide Seqeunce of DNA binding domain of ZF5 protein-no effector

SEQ ID NO.: 235

CUCGAACCGGGCGAGAAACCAUAUAAGUGUCCAGAGUGUGGUAAGAGCUUUAGCACCAGUGGCAAUCUGACCGAGCAUCAACG

CACGCAUACGGGUGAGAAACCGUACAAGUGCCCGGAAUGCGGCAAAAGUUUCAGCGAUAGCGGCAAUCUGCGUGUGCACCAGC

GUACGCAUACGGGCGAAAAGCCGUAUAAGUGCCCAGAAUGCGGUAAGAGUUUUAGCCACAAAAACGCGCUGCAGAACCACCAG

CGCACCCACACGGGUGAGAAGCCAUACAAAUGUCCGGAAUGCGGCAAAAGCUUCAGCCGCAACGAUACGCUGACGGAACACCA

ACGUACGCAUACCGGCGAAAAGCCAUACAAGUGCCCGGAGUGCGGUAAAAGCUUUAGCCAGCGCGCGCAUCUCGAACGUCAUC

AACGUACCCAUACCGGUGAAAAACCAUAUAAAUGCCCGGAAUGUGGUAAAAGUUUUAGCCGCAGCGACAAACUGGUGCGUCAU

CAACGCACCCAUACCGGUGAAAAGCCAUAUAAGUGCCCGGAGUGUGGUAAAAGCUUCAGCGAUCCGGGUCAUCUGGUUCGCCA

UCAACGUACGCACACCGGCGAGAAGCCAACCGGCAAGAAAACCAGC

>ZF5 mRNA-no effector

SEQ ID NO.: 175

AGGAAAUAAGAGAGAAAAGAAGAGUAAGAAGAAAUAUAAGAGCCACCAUGGCCCCCAAGAAGAAGCGGAAGGUGGGCAUCCAC

GGCGUGCCCGCCGCCGGCAGCAGCGGAUCCCUCGAACCGGGCGAGAAACCAUAUAAGUGUCCAGAGUGUGGUAAGAGCUUUAG

CACCAGUGGCAAUCUGACCGAGCAUCAACGCACGCAUACGGGUGAGAAACCGUACAAGUGCCCGGAAUGCGGCAAAAGUUUCA

GCGAUAGCGGCAAUCUGCGUGUGCACCAGCGUACGCAUACGGGCGAAAAGCCGUAUAAGUGCCCAGAAUGCGGUAAGAGUUUU

AGCCACAAAAACGCGCUGCAGAACCACCAGCGCACCCACACGGGUGAGAAGCCAUACAAAUGUCCGGAAUGCGGCAAAAGCUU

CAGCCGCAACGAUACGCUGACGGAACACCAACGUACGCAUACCGGCGAAAAGCCAUACAAGUGCCCGGAGUGCGGUAAAAGCU

UUAGCCAGCGCGCGCAUCUCGAACGUCAUCAACGUACCCAUACCGGUGAAAAACCAUAUAAAUGCCCGGAAUGUGGUAAAAGU

UUUAGCCGCAGCGACAAACUGGUGCGUCAUCAACGCACCCAUACCGGUGAAAAGCCAUAUAAGUGCCCGGAGUGUGGUAAAAG

CUUCAGCGAUCCGGGUCAUCUGGUUCGCCAUCAACGUACGCACACCGGCGAGAAGCCAACCGGCAAGAAAACCAGCGCUAGCA

GCGGCGGCAAGCGGCCCGCCGCCACCAAGAAGGCCGGCCAGGCCAAGAAGAAGAAGGGCAGCUACCCCUACGACGUGCCCGAC

UACGCCUGAGCGGCCGCUUAAUUAAGCUGCCUUCUGCGGGGCUUGCCUUCUGGCCAUGCCCUUCUUCUCUCCCUUGCACCUGU

ACCUCUUGGUCUUUGAAUAAAGCCUGAGUAGGAAGUCUAGAAAAAAAAAAAAAAAAAAAAAAAAAAAAAAAAAAAAAAAAAAA

AAAAAAAAAAAAAAAAAAAAAAAAAAAAAAAAA

>ZF5.3-VPR-tPT2a-ZF7-VPR protein

SEQ ID NO.: 176

MAPKKKRKVGIHGVPAAGSSGSSGSLEPGEKPYKCPECGKSFSTSGNLTEHQRTHTGEKPYKCPECGKSFSDSGNLRVHQRTH
TGEKPYKCPECGKSFSHKNALQNHQRTHTGEKPYKCPECGKSFSRNDTLTEHQRTHTGEKPYKCPECGKSFSQRAHLERHQRT
HTGEKPYKCPECGKSFSRSDKLVRHQRTHTGEKPYKCPECGKSFSDPGHLVRHQRTHTGEKPTGKKTSASGSGGGSGGDALDD
FDLDMLGSDALDDFDLDMLGSDALDDFDLDMLGSDALDDFDLDMLSGGPKKKRKVGSQYLPDTDDRHRIEEKRKRTYETFKSI
MKKSPFSGPTDPRPPPRRIAVPSRSSASVPKPAPQPYPFTSSLSTINYDEFPTMVFPSGQISQASALAPAPPQVLPQAPAPAP
APAMVSALAQAPAPVPVLAPGPPQAVAPPAPKPTQAGEGTLSEALLQLQFDDEDLGALLGNSTDPAVFTDLASVDNSEFQQLL
NQGIPVAPHTTEPMLMEYPEAITRLVTGAQRPPDPAPAPLGAPGLPNGLLSGDEDFSSIADMDFSALLGSGSGSRDSREGMFL
PKPEAGSAISDVFEGREVCQPKRLRPFHPPGSPWANRPLPASLAPTPTGPVHEPVGSLTPAPVPQPLDPAPAVTPEASHLLED
PDEETSQAVKALREMADTVIPQKEEAAICGQMDLSHPPPRGHLDELTTTLESMTEDLNLDSPLTPELNEILDTFLNDECLLHA
MHISTGLSIFDTSLFSGGKRPAATKKAGQAKKKKGSYPYDVPDYAATNFSLLKQAGDVEENPGPTSAGKLGSGEGRGSLLTCG
DVEENPGPLEGSSGSGSLEPGEKPYKCPECGKSFSRSDHLTNHQRTHTGEKPYKCPECGKSFSTSGSLVRHQRTHTGEKPYKC
PECGKSFSQAGHLASHQRTHTGEKPYKCPECGKSFSRSDKLTEHQRTHTGEKPYKCPECGKSFSTSGNLTEHQRTHTGEKPYK
CPECGKSFSQSSNLVRHQRTHTGEKPYKCPECGKSFSTHLDLIRHQRTHTGEKPTGKKTSASGSGGGSGGDALDDFDLDMLGS
DALDDFDLDMLGSDALDDFDLDMLGSDALDDFDLDMLSGGPKKKRKVGSQYLPDTDDRHRIEEKRKRTYETFKSIMKKSPFSG
PTDPRPPPRRIAVPSRSSASVPKPAPQPYPFTSSLSTINYDEFPTMVFPSGQISQASALAPAPPQVLPQAPAPAPAPAMVSAL
AQAPAPVPVLAPGPPQAVAPPAPKPTQAGEGTLSEALLQLQFDDEDLGALLGNSTDPAVFTDLASVDNSEFQQLLNQGIPVAP
HTTEPMLMEYPEAITRLVTGAQRPPDPAPAPLGAPGLPNGLLSGDEDFSSIADMDFSALLGSGSGSRDSREGMFLPKPEAGSA
ISDVFEGREVCQPKRLRPFHPPGSPWANRPLPASLAPTPTGPVHEPVGSLTPAPVPQPLDPAPAVTPEASHLLEDPDEETSQA
VKALREMADTVIPQKEEAAICGQMDLSHPPPRGHLDELTTTLESMTEDLNLDSPLTPELNEILDTFLNDECLLHAMHISTGLS
IFDTSLFSGGKRPAATKKAGQAKKKKGSYPYDVPDYA*

>ZF5.3-VPR-tPT2a-ZF7-VPR mRNA

SEQ ID NO.: 177

AGGAAAUAAGAGAGAAAAGAAGAGUAAGAAGAAAUAUAAGAGCCACCAUGGCCCCCAAGAAGAAGCGGAAGGUGGGCAUCCAC
GGCGUGCCCGCCGCCGGCAGCAGCGGAUCAUCAGGCUCACUGGAACCGGGGGAAAAACCCUACAAGUGCCCGGAAUGCGGCAA
GAGCUUCUCGACCUCCGGGAACCUGACCGAGCACCAGCGCACCCACACCGGAGAGAAACCGUACAAGUGCCCCGAAUGCGGGA
AAUCGUUCUCAGACUCGGGAAACCUCAGGGUGCACCAGCGGACCCACACGGGGGAAAAGCCGUACAAAUGCCCGGAGUGCGGG
AAGUCAUUCUCCCACAAGAACGCGCUGCAGAACCACCAAAGAACCCACACCGGCGAAAAACCGUACAAGUGCCCCGAGUGCGG
AAAGUCCUUCUCCCGCAACGACACCCUCACCGAACACCAACGCACCCACACCGGAGAAAAGCCCUACAAGUGCCCGGAAUGCG
GAAAGAGCUUCAGCCAGAGGGCCCACCUGGAAAGACACCAGAGAACCCACACCGGCGAAAAGCCGUACAAAUGCCCGGAGUGC
GGGAAGUCCUUCAGCCGGUCAGACAAGCUGGUCCGCCACCAAAGGACCCACACAGGAGAAAAGCCCUACAAGUGCCCGGAAUG
CGGAAAAUCGUUCAGCGACCCCGGACACCUGGUCCGGCACCAGAGGACCCACACCGGGGAGAAGCCGACCGGCAAAAAGACCU
CAGCGAGCGGAUCAGGAGGAGGAUCAGGGGGGGACGCACUGGACGACUUCGACCUGGACAUGCUGGGAUCAGACGCACUGGAC
GACUUCGACCUAGACAUGCUCGGAUCGGACGCACUCGACGACUUCGACCUCGACAUGCUAGGAUCAGACGCACUAGACGACUU
CGACCUCGACAUGCUGUCGGGAGGACCGAAGAAAAAGCGGAAGGUCGGAUCACAGUACCUCCCGGACACCGACGACAGGCACA
GAAUCGAAGAAAAACGCAAGCGCACCUACGAAACCUUCAAGAGCAUCAUGAAAAAGUCGCCGUUCUCAGGACCGACCGACCCC
AGACCGCCACCGAGGAGAAUAGCCGUCCCGAGCCGAUCCUCCGCAUCCGUGCCGAAACCGGCACCGCAACCCUACCCGUUCAC
CUCGUCCCUGUCGACCAUCAACUACGACGAGUUCCCCACCAUGGUGUUCCCCUCCGGGCAGAUCUCACAGGCCUCGGCACUGG
CACCCGCACCACCGCAAGUGCUGCCCCAAGCACCGGCACCCGCACCGGCGCCCGCAAUGGUGUCAGCGCUGGCACAGGCACCA
GCACCGGUGCCAGUCCUCGCACCGGGACCGCCGCAAGCAGUGGCACCGCCGGCACCGAAACCGACCCAGGCCGGAGAAGGGAC
CCUGUCCGAGGCGCUGCUGCAACUCCAGUUCGACGACGAGGACCUGGGAGCACUCCUGGGAAACUCCACCGACCCGGCAGUGU
UCACCGACCUCGCAUCGGUGGACAACUCCGAGUUCCAACAGCUCCUGAACCAGGGGAUACCGGUGGCACCGCACACCACCGAA

-continued

```
CCGAUGCUGAUGGAAUACCCGGAAGCCAUCACCCGGCUCGUGACCGGAGCGCAAAGACCGCCCGACCCCGCGCCCGCACCGCU
GGGAGCACCGGGACUACCGAACGGGCUGCUCUCAGGGGACGAGGACUUCUCCAGCAUCGCAGACAUGGACUUCUCCGCCCUGC
UGGGAUCAGGAUCAGGAUCACGCGACUCCCGGGAAGGAAUGUUCCUGCCGAAGCCGGAAGCAGGCAGCGCAAUCUCCGACGUG
UUCGAAGGCCGCGAGGUCUGCCAGCCCAAGCGCCUGCGACCGUUCCACCCGCCGGGAUCACCGUGGGCAAACCGCCCGCUACC
GGCAUCACUGGCACCGACACCCACCGGACCGGUGCACGAACCGGUCGGGUCACUGACCCCCGCACCGGUCCCGCAACCGCUAG
ACCCGGCACCGGCAGUGACCCCGGAAGCAUCGCACCUCCUGGAGGACCCGGACGAGGAAACCUCACAGGCAGUGAAGGCCCUG
CGGGAGAUGGCCGACACCGUGAUACCGCAGAAGGAGGAGGCCGCCAUCUGCGGACAAAUGGACCUGUCACACCCGCCCCCGAG
AGGACACCUGGACGAACUCACCACCACCCUGGAGAGCAUGACCGAGGACCUGAACCUGGACUCACCGCUGACCCCGGAGCUGA
ACGAAAUCCUGGACACCUUCCUGAACGACGAGUGCCUGCUGCACGCAAUGCACAUCAGCACCGGGCUGUCGAUCUUCGACACC
AGCCUGUUCUCCGGAGGGAAAAGACCCGCCGCCACCAAGAAAGCGGGCCAAGCAAAGAAAAAGAAGGGAUCGUACCCCUACGA
CGUGCCGGACUACGCAGCCACCAACUUUUCUCUGCUGAAGCAAGCCGGAGAUGUGGAGGAGAAUCCCGGCCCUACCUCCGCCG
GAAAACUGGGCUCCGGCGAAGGCAGAGGAAGCCUCCUCACAUGCGGCGACGUGGAGGAGAACCCCGGCCCUCUGGAGGGAUCC
UCAGGCUCAGGAUCCCUGGAACCGGGCGAGAAGCCAUACAAGUGCCCAGAGUGCGGCAAAAGCUUCAGCCGCAGCGACCAUCU
GACCAAUCACCAACGCACCCAUACCGGUGAGAAGCCGUACAAAUGCCAGAGUGCGGUAAGAGCUUUAGUACCAGUGGCAGUC
UGGUUCGUCAUCAGCGCACGCACACGGGCGAAAAACCAUACAAAUGCCCGGAGUGCGGCAAAAGCUUUAGCCAAGCCGGUCAU
CUGGCGAGCCAUCAACGUACGCACACCGGCGAGAAGCCGUAUAAAUGUCCGGAGUGCGGUAAGAGCUUUAGCCGUAGCGAUAA
ACUGACCGAACACCAACGUACGCAUACGGGCGAGAAACCAUAUAAAUGUCCAGAGUGUGGCAAGAGUUUCAGCACCAGCGGCA
AUCUGACCGAGCAUCAACGUACCCAUACCGGUGAAAAGCCAUAUAAAUGUCCAGAAUGCGGUAAGAGUUUUAGUCAGAGCAGU
AAUCUGGUGCGCCAUCAGCGUACCCACACGGGUGAGAAACCAUAUAAGUGUCCGGAAUGCGGCAAGAGUUUUAGCACCCAUCU
GGAUCUGAUCCGUCAUCAGCGCACCCACACCGGUGAAAAACCAACCGGCAAGAAAACCAGUGCUAGCGGCAGCGGCGGCGGCA
GCGGCGGCGACGCCCUGGACGACUUCGACCUGGACAUGCUGGGCAGCGACGCCCUGGACGACUUCGACCUGGACAUGCUGGGC
AGCGACGCCCUGGACGACUUCGACCUGGACAUGCUGGGCAGCGACGCCCUGGACGACUUCGACCUGGACAUGCUGAGCGGCGG
CCCCAAGAAGAAGCGGAAGGUGGGCAGCCAGUACCUGCCCGACACCGACGACCGGCACCGGAUCGAGGAGAAGCGGAAGCGGA
CCUACGAGACCUUCAAGAGCAUCAUGAAGAAAUCCCCCUUCAGCGGCCCCACCGACCCCCGGCCCCCCCCCCGGCGGAUCGCC
GUGCCCAGCCGGAGCAGCGCCAGCGUGCCCAAGCCCGCCCCCCAGCCCUACCCCUUCACCAGCAGCCUGAGCACCAUCAACUA
CGACGAGUUCCCCACCAUGGUGUUCCCCAGCGGCCAGAUCAGCCAGGCCAGCGCCCUGGCCCCCGCCCCCCCCCAGGUGCUGC
CCCAGGCCCCCGCCCCCGCCCCCGCCCCCGCCAUGGUGAGCGCCCUGGCCCAGGCCCCCGCCCCCGUGCCCGUCUGGCCCCC
GGCCCCCCCCAGGCCGUGGCCCCCCCCGCCCCCAAGCCCACCCAGGCCGGCGAGGGCACCCUGAGCGAGGCCCUGCUGCAGCU
GCAGUUCGACGACGAGGACCUGGGCGCCCUGCUGGGCAACAGCACCGACCCCGCCGUGUUCACCGACCUGGCCAGCGUGGACA
ACAGCGAGUUCCAGCAGCUGCUGAACCAGGGCAUCCCCGUGGCCCCCCACACCACCGAGCCCAUGCUGAUGGAGUACCCCGAG
GCCAUCACCCGGCUGGUGACCGGCGCCCAGCGGCCCCCCGACCCCGCCCCCGCCCCCUGGGCGCCCCCGGCCUGCCCAACGG
CCUGCUGAGCGGCGACGAGGACUUCAGCAGCAUCGCCGACAUGGACUUCAGCGCCCUGCUGGGCAGCGGCAGCGGCAGCCGGG
ACAGCCGGGAGGGCAUGUUCCUGCCCAAGCCCGAGGCCGGCAGCGCCAUCAGCGACGUGUUCGAGGGCCGGGAGGUGUGCCAG
CCCAAGCGGCUCCGGCCCUUCCACCCCCCCGGCAGCCCCUGGGCCAACCGGCCCCUGCCCGCCAGCCUGGCCCCCACCCCCAC
CGGCCCCGUGCACGAGCCCGUGGGCAGCCUGACCCCCGCCCCCGUGCCCAGCCCCUGGACCCCGCCCCCGCCGUGACCCCCG
AGGCCAGCCACCUGCUGGAGGACCCCGACGAGGAGACCAGCCAGGCCGUGAAGGCCCUGCGGGAGAUGGCCGACACCGUGAUC
CCCCAGAAGGAGGAGGCCGCCAUCUGCGGCCAGAUGGACCUGAGCCACCCCCCCCCCGGGGCCACCUGGACGAGCUGACCAC
CACCCUGGAGAGCAUGACCGAGGACCUGAACCUGGACAGCCCCCUGACCCCCGAGCUGAACGAGAUCCUGGACACCUUCCUGA
ACGACGAGUGCCUGCUGCACGCCAUGCACAUCAGCACCGGCCUGAGCAUCUUCGACACCAGCCUGUUCAGCGGCGGCAAGCGG
CCCGCCGCCACCAAGAAGGCCGGCCAGGCCAAGAAGAAGAAGGGCAGCUACCCCUACGACGUGCCCGACUACGCCUGAGCGGC
```

-continued

CGCUUAAUUAAGCUGCCUUCUGCGGGGCUUGCCUUCUGGCCAUGCCCUUCUUCUCUCCCUUGCACCUGUACCUCUUGGUCUUU

GAAUAAAGCCUGAGUAGGAAGUCUAGAAAAAAAAAAAAAAAAAAAAAAAAAAAAAAAAAAAAAAAAAAAAAAAAAAAAAAAAA

AAAAAAAAAAAAAAAAAAAAAAA

>Nucleotide Seqeunce of DNA binding domain of ZF5.3-VPR-tPT2a-ZF7-VPR; 1
SEQ ID NO.: 236
CUGGAACCGGGGGAAAAACCCUACAAGUGCCCGGAAUGCGGCAAGAGCUUCUCGACCUCCGGGAACCUGACCGAGCACCAGCG CACCCACACCGGAGAGAAACCGUACAAGUGCCCCGAAUGCGGGAAAUCGUUCUCAGACUCGGGAAACCUCAGGGUGCACCAGC GGACCCACACGGGGGAAAAGCCGUACAAAUGCCCGGAGUGCGGGAAGUCAUUCUCCCACAAGAACGCGCUGCAGAACCACCAA AGAACCCACACCGGCGAAAAACCGUACAAGUGCCCCGAGUGCGGAAAGUCCUUCUCCCGCAACGACACCCUCACCGAACACCA ACGCACCCACACCGGAGAAAAGCCCUACAAGUGCCCGGAUGCGGAAAGAGCUUCAGCCAGAGGGCCCACCUGGAAAGACACC AGAGAACCCACACCGGCGAAAAGCCGUACAAAUGCCCGGAGUGCGGGAAGUCCUUCAGCCGGUCAGACAAGCUGGUCCGCCAC CAAAGGACCCACACAGGAGAAAAGCCCUACAAGUGCCCGGAAUGCGGAAAAUCGUUCAGCGACCCCGGACACCUGGUCCGGCA

CCAGAGGACCCACACCGGGGAGAAGCCGACCGGCAAAAAGACCUCA

>Nucleotide Seqeunce of DNA binding domain of ZF5.3-VPR-tPT2a-ZF7-VPR; 2
SEQ ID NO.: 237
CTGGAACCGGGCGAGAAGCCAUACAAGUGCCCCAGAGUGCGGCAAAAGCUUCAGCCGCAGCGACCAUCUGACCAAUCACCAACG CACCCAUACCGGUGAGAAGCCGUACAAAUGCCCAGAGUGCGGUAAGAGCUUUAGUACCAGUGGCAGUCUGGUUCGUCAUCAGC GCACGCACACGGGCGAAAAACCAUACAAAUGCCCGGAGUGCGGCAAAAGCUUUAGCCAAGCCGGUCAUCUGGCGAGCCAUCAA CGUACGCACACCGGCGAGAAGCCGUAUAAAUGUCCGGAGUGCGGUAAGAGCUUUAGCCGUAGCGAUAAACUGACCGAACACCA ACGUACGCAUACGGGCGAGAAACCAUAUAAAUGUCCAGAGUGUGGCAAGAGUUUCAGCACCAGCGGCAAUCUGACCGAGCAUC AACGUACCCAUACCGGUGAAAAGCCAUAUAAAUGUCCAGAAUGCGGUAAGAGUUUUAGUCAGAGCAGUAAUCUGGUGCGCCAU CAGCGUACCCACACGGGUGAGAAACCAUAUAAGUGUCCGGAAUGCGGCAAGAGUUUUAGCACCCAUCUGGAUCUGAUCCGUCA

TCAGCGCACCCACACCGGUGAAAAACCAACCGGCAAGAAAACCAGT

>ZF7-VPR-tPT2a-ZF5.3-VPR protein
SEQ ID NO.: 178
MAPKKKRKVGIHGVPAAGSSGSLEPGEKPYKCPECGKSFSRSDHLTNHQRTHTGEKPYKCPECGKSFSTSGSLVRHQRTHTGE KPYKCPECGKSFSQAGHLASHQRTHTGEKPYKCPECGKSFSRSDKLTEHQRTHTGEKPYKCPECGKSFSTSGNLTEHQRTHTG EKPYKCPECGKSFSQSSNLVRHQRTHTGEKPYKCPECGKSFSTHLDLIRHQRTHTGEKPTGKKTSASGSGGGSGGDALDDFDL DMLGSDALDDFDLDMLGSDALDDFDLDMLGSDALDDFDLDMLSGGPKKKRKVGSQYLPDTDDRHRIEEKRKRTYETFKSIMKK SPFSGPTDPRPPPRRIAVPSRSSASVPKPAPQPYPFTSSLSTINYDEFPTMVFPSGQISQASALAPAPPQVLPQAPAPAPAPA MVSALAQAPAPVPVLAPGPPQAVAPPAPKPTQAGEGTLSEALLQLQFDDEDLGALLGNSTDPAVFTDLASVDNSEFQQLLNQG IPVAPHTTEPMLMEYPEAITRLVTGAQRPPDPAPAPLGAPGLPNGLLSGDEDFSSIADMDFSALLGSGSGSRDSREGMFLPKP EAGSAISDVFEGREVCQPKRLRPFHPPGSPWANRPLPASLAPTPTGPVHEPVGSLTPAPVPQPLDPAPAVTPEASHLLEDPDE ETSQAVKALREMADTVIPQKEEAAICGQMDLSHPPPRGHLDELTTTLESMTEDLNLDSPLTPELNEILDTFLNDECLLHAMHI STGLSIFDTSLFSGGKRPAATKKAGQAKKKKGSYPYDVPDYAATNFSLLKQAGDVEENPGPTSAGKLGSGEGRGSLLTCGDVE ENPGPLEGSSGSLEPGEKPYKCPECGKSFSTSGNLTEHQRTHTGEKPYKCPECGKSFSDSGNLRVHQRTHTGEKPYKCPECGK SFSHKNALQNHQRTHTGEKPYKCPECGKSFSRNDTLTEHQRTHTGEKPYKCPECGKSFSQRAHLERHQRTHTGEKPYKCPECG KSFSRSDKLVRHQRTHTGEKPYKCPECGKSFSDPGHLVRHQRTHTGEKPTGKKTSASGSGGGSGGDALDDFDLDMLGSDALDD FDLDMLGSDALDDFDLDMLGSDALDDFDLDMLSGGPKKKRKVGSQYLPDTDDRHRIEEKRKRTYETFKSIMKKSPFSGPTDPR PPPRRIAVPSRSSASVPKPAPQPYPFTSSLSTINYDEFPTMVFPSGQISQASALAPAPPQVLPQAPAPAPAPAMVSALAQAPA PVPVLAPGPPQAVAPPAPKPTQAGEGTLSEALLQLQFDDEDLGALLGNSTDPAVFTDLASVDNSEFQQLLNQGIPVAPHTTEP MLMEYPEAITRLVTGAQRPPDPAPAPLGAPGLPNGLLSGDEDFSSIADMDFSALLGSGSGSRDSREGMFLPKPEAGSAISDVF -continued EGREVCQPKRLRPFHPPGSPWANRPLPASLAPTPTGPVHEPVGSLTPAPVPQPLDPAPAVTPEASHLLEDPDEETSQAVKALR
EMADTVIPQKEEAAICGQMDLSHPPPRGHLDELTTTLESMTEDLNLDSPLTPELNEILDTFLNDECLLHAMHISTGLSIFDTS
LFSGGKRPAATKKAGQAKKKKGSYPYDVPDYA >ZF7-VPR-tPT2a-ZF5.3-VPR mRNA

SEQ ID NO.: 179

AGGAAAUAAGAGAGAAAAGAAGAGUAAGAAGAAAUAUAAGAGCCACCAUGGCCCCCAAGAAGAAGCGGAAGGUGGGCAUCCAC
GGCGUGCCCGCCGCCGGCAGCAGCGGAUCCCUGGAACCGGGCGAGAAGCCAUACAAGUGCCCAGAGUGCGGCAAAAGCUUCAG
CCGCAGCGACCAUCUGACCAAUCACCAACGCACCCAUACCGGUGAGAAGCCGUACAAAUGCCCAGAGUGCGGUAAGAGCUUUA
GUACCAGUGGCAGUCUGGUUCGUCAUCAGCGCACGCACACGGGCGAAAAACCAUACAAAUGCCCGGAGUGCGGCAAAAGCUUU
AGCCAAGCCGGUCAUCUGGCGAGCCAUCAACGUACGCACACCGGCGAGAAGCCGUAUAAAUGUCCGGAGUGCGGUAAGAGCUU
UAGCCGUAGCGAUAAACUGACCGAACACCAACGUACGCAUACGGGCGAGAAACCAUAUAAAUGUCCAGAGUGUGGCAAGAGUU
UCAGCACCAGCGGCAAUCUGACCGAGCAUCAACGUACCCAUACCGGUGAAAAGCCAUAUAAAUGUCCAGAAUGCGGUAAGAGU
UUUAGUCAGAGCAGUAAUCUGGUGCGCCAUCAGCGUACCCACACGGGUGAGAAACCAUAUAAGUGUCCGGAAUGCGGCAAGAG
UUUUAGCACCCAUCUGGAUCUGAUCCGUCAUCAGCGCACCCACACCGGUGAAAAACCAACCGGCAAGAAAACCAGUGCUAGCG
GCAGCGGCGGCGGCAGCGGCGGCGACGCCCUGGACGACUUCGACCUGGACAUGCUGGGCAGCGACGCCCUGGACGACUUCGAC
CUGGACAUGCUGGGCAGCGACGCCCUGGACGACUUCGACCUGGACAUGCUGGGCAGCGACGCCCUGGACGACUUCGACCUGGA
CAUGCUGAGCGGCGGCCCCAAGAAGAAGCGGAAGGUGGGCAGCCAGUACCUGCCCGACACCGACGACCGGCACCGGAUCGAGG
AGAAGCGGAAGCGGACCUACGAGACCUUCAAGAGCAUCAUGAAGAAAUCCCCCUUCAGCGGCCCCACCGACCCCCGGCCCCCC
CCCCGGCGGAUCGCCGUGCCCAGCCGGAGCAGCGCCAGCGUGCCCAAGCCCGCCCCCCAGCCCUACCCCUUCACCAGCAGCCU
GAGCACCAUCAACUACGACGAGUUCCCCACCAUGGUGUUCCCCAGCGGCCAGAUCAGCCAGGCCAGCGCCCUGGCCCCCGCCC
CCCCCCAGGUGCUGCCCCAGGCCCCCGCCCCCGCCCCCGCCCCCGCCAUGGUGAGCGCCCUGGCCCAGGCCCCCGCCCCCGUG
CCCGUGCUGGCCCCCGGCCCCCCCCAGGCCGUGGCCCCCCCCGCCCCCAAGCCCACCCAGGCCGGCGAGGGCACCCUGAGCGA
GGCCCUGCUGCAGCUGCAGUUCGACGACGAGGACCUGGGCGCCCUGCUGGGCAACAGCACCGACCCCGCCGUGUUCACCGACC
UGGCCAGCGUGGACAACAGCGAGUUCCAGCAGCUGCUGAACCAGGGCAUCCCCGUGGCCCCCCACACCACCGAGCCCAUGCUG
AUGGAGUACCCCGAGGCCAUCACCCGGCUGGUGACCGGCGCCCAGCGGCCCCCCGACCCCGCCCCCGCCCCCCUGGGCGCCCC
CGGCCUGCCCAACGGCCUGCUGAGCGGCGACGAGGACUUCAGCAGCAUCGCCGACAUGGACUUCAGCGCCCUGCUGGGCAGCG
GCAGCGGCAGCCGGGACAGCCGGGAGGGCAUGUUCCUGCCCAAGCCCGAGGCCGGCAGCGCCAUCAGCGACGUGUUCGAGGGC
CGGGAGGUGUGCCAGCCCAAGCGGCUCCGGCCCUUCCACCCCCCCGGCAGCCCCUGGGCCAACCGGCCCCUGCCCGCCAGCCU
GGCCCCCACCCCCACCGGCCCCGUGCACGAGCCCGUGGGCAGCCUGACCCCCGCCCCCGUGCCCCAGCCCCUGGACCCCGCCC
CCGCCGUGACCCCCGAGGCCAGCCACCUGCUGGAGGACCCCGACGAGGAGACCAGCCAGGCCGUGAAGGCCCUGCGGGAGAUG
GCCGACACCGUGAUCCCCCAGAAGGAGGAGGCCGCCAUCUGCGGCCAGAUGGACCUGAGCCACCCCCCCCCCCGGGGCCACCU
GGACGAGCUGACCACCACCCUGGAGAGCAUGACCGAGGACCUGAACCUGGACAGCCCCCUGACCCCCGAGCUGAACGAGAUCC
UGGACACCUUCCUGAACGACGAGUGCCUGCUGCACGCCAUGCACAUCAGCACCGGCCUGAGCAUCUUCGACACCAGCCUGUUC
AGCGGCGGCAAGCGGCCCGCCGCCACCAAGAAGGCCGGCCAGGCCAAGAAGAAGAAGGGCAGCUACCCCUACGACGUGCCCGA
CUACGCCGCCACCAACUUUUCUCUGCUGAAGCAAGCCGGAGAUGUGGAGGAGAAUCCCGGCCCUACCUCCGCCGGAAAACUGG
GCUCCGGCAAGGCAGAGGAAGCCUCCUCACAUGCGGCGACGUGGAGGAGAACCCCGGCCCUCUGGAGGGAUCCUCAGGCUCA
CUGGAACCGGGGGAAAAACCCUACAAGUGCCCGGAAUGCGGCAAGAGCUUCUCGACCUCCGGGAACCUGACCGAGCACCAGCG
CACCCACACCGGAGAGAAACCGUACAAGUGCCCCGAAUGCGGGAAAUCGUUCUCAGACUCGGGAAACCUCAGGGUGCACCAGC
GGACCCACACGGGGGAAAAGCCGUACAAAUGCCCGGAGUGCGGGAAGUCAUUCUCCCACAAGAACGCGCUGCAGAACCACCAA
AGAACCCACACCGGCGAAAAACCGUACAAGUGCCCCGAGUGCGGAAAGUCCUUCUCCCGCAACGACACCCUCACCGAACACCA
ACGCACCCACACCGGAGAAAAGCCCUACAAGUGCCCGGAAUGCGGAAAGAGCUUCAGCCAGAGGGCCCACCUGGAAAGACACC

-continued

AGAGAACCCACACCGGCGAAAAGCCGUACAAAUGCCCGGAGUGCGGGAAGUCCUUCAGCCGGUCAGACAAGCUGGUCCGCCAC

CAAAGGACCCACACAGGAGAAAAGCCCUACAAGUGCCCGGAAUGCGGAAAAUCGUUCAGCGACCCCGGACACCUGGUCCGGCA

CCAGAGGACCCACACCGGGGAGAAGCCGACCGGCAAAAAGACCUCAGCGAGCGGAUCAGGAGGAGGAUCAGGGGGGGACGCAC

UGGACGACUUCGACCUGGACAUGCUGGGAUCAGACGCACUGGACGACUUCGACCUAGACAUGCUCGGAUCGGACGCACUCGAC

GACUUCGACCUCGACAUGCUAGGAUCAGACGCACUAGACGACUUCGACCUCGACAUGCUGUCGGGAGGACCGAAGAAAAAGCG

GAAGGUCGGAUCACAGUACCUCCCGGACACCGACGACAGGCACAGAAUCGAAGAAAAACGCAAGCGCACCUACGAAACCUUCA

GAGCAUCAUGAAAAAGUCGCCGUUCUCAGGACCGACCGACCCCAGACCGCCACCGAGGAGAAUAGCCGUCCCGAGCCGAUCC

UCCGCAUCCGUGCCGAAACCGGCACCGCAACCCUACCCGUUCACCUCGUCCCUGUCGACCAUCAACUACGACGAGUUCCCCAC

CAUGGUGUUCCCCUCCGGGCAGAUCUCACAGGCCUCGGCACUGGCACCCGCACCACCGCAAGUGCUGCCCCAAGCACCGGCAC

CCGCACCGGCGCCCGCAAUGGUGUCAGCGCUGGCACAGGCACCAGCACCGGUGCCAGUCCUCGCACCGGGACCGCCGCAAGCA

GUGGCACCGCCGGCACCGAAACCGACCCAGGCCGGAGAAGGGACCCUGUCCGAGGCGCUGCUGCAACUCCAGUUCGACGACGA

GGACCUGGGAGCACUCCUGGGAAACUCCACCGACCCGGCAGUGUUCACCGACCUCGCAUCGGUGGACAACUCCGAGUUCCAAC

AGCUCCUGAACCAGGGGAUACCGGUGGCACCGCACACCACCGAACCGAUGCUGAUGGAAUACCCGGAAGCCAUCACCCGGCUC

GUGACCGGAGCGCAAAGACCGCCCGACCCCGCGCCCGCACCGCUGGGAGCACCGGGACUACCGAACGGGCUGCUCUCAGGGGA

CGAGGACUUCUCCAGCAUCGCAGACAUGGACUUCUCCGCCCUGCUGGGAUCAGGAUCAGGAUCACGCGACUCCCGGGAAGGAA

UGUUCCUGCCGAAGCCGGAAGCAGGCAGCGCAAUCUCCGACGUGUUCGAAGGCCGCGAGGUCUGCCAGCCCAAGCGCCUGCGA

CCGUUCCACCCGCCGGGAUCACCGUGGGCAAACCGCCCGCUACCGGCAUCACUGGCACCGACACCCACCGGACCGGUGCACGA

ACCGGUCGGGUCACUGACCCCCGCACCGGUCCCGCAACCGCUAGACCCGGCACCGGCAGUGACCCCGGAAGCAUCGCACCUCC

UGGAGGACCCGGACGAGGAAACCUCACAGGCAGUGAAGGCCCUGCGGAGAUGGCCGACACCGUGAUACCGCAGAAGGAGGAG

GCCGCCAUCUGCGGACAAAUGGACCUGUCACACCCGCCCCCGAGAGGACACCUGGACGAACUCACCACCACCCUGGAGAGCAU

GACCGAGGACCUGAACCUGGACUCACCGCUGACCCCGGAGCUGAACGAAAUCCUGGACACCUUCCUGAACGACGAGUGCCUGC

UGCACGCAAUGCACAUCAGCACCGGGCUGUCGAUCUUCGACACCAGCCUGUUCUCCGGAGGGAAAAGACCCGCCGCCACCAAG

AAAGCGGGCCAAGCAAAGAAAAAGAAGGGAUCGUACCCCUACGACGUGCCGGACUACGCAUGAGCGGCCGCUUAAUUAAGCUG

CCUUCUGCGGGGCUUGCCUUCUGGCCAUGCCCUUCUUCUCUCCCUUGCACCUGUACCUCUUGGUCUUUGAAUAAAGCCUGAGU

AGGAAGUCUAGAAAAAAAAAAAAAAAAAAAAAAAAAAAAAAAAAAAAAAAAAAAAAAAAAAAAAAAAAAAAAAAAAAAAAAAA

AAAAAAAA

>Nucleotide Seqeunce of DNA binding domain of ZF7-VPR-tPT2a-ZF5.3-VPR; 1

SEQ ID NO.: 238

CUGGAACCGGGCGAGAAGCCAUACAAGUGCCCAGAGUGCGGCAAAAGCUUCAGCCGCAGCGACCAUCUGACCAAUCACCAACG

CACCCAUACCGGUGAGAAGCCGUACAAAUGCCCAGAGUGCGGUAAGAGCUUUAGUACCAGUGGCAGUCUGGUUCGUCAUCAGC

GCACGCACACGGGCGAAAAACCAUACAAAUGCCCGGAGUGCGGCAAAAGCUUUAGCCAAGCCGGUCAUCUGGCGAGCCAUCAA

CGUACGCACACCGGCGAGAAGCCGUAUAAAUGUCCGGAGUGCGGUAAGAGCUUUAGCCGUAGCGAUAAACUGACCGAACACCA

ACGUACGCAUACGGGCGAGAAACCAUAUAAAUGUCCAGAGUGUGGCAAGAGUUUCAGCACCAGCGGCAAUCUGACCGAGCAUC

AACGUACCCAUACCGGUGAAAAGCCAUAUAAAUGUCCAGAAUGCGGUAAGAGUUUUAGUCAGAGCAGUAAUCUGGUGCGCCAU

CAGCGUACCCACACGGGUGAGAAACCAUAUAAGUGUCCGGAAUGCGGCAAGAGUUUUAGCACCCAUCUGGAUCUGAUCCGUCA

UCAGCGCACCCACACCGGUGAAAACCAACCGGCAAGAAAACCAGU

>Nucleotide Seqeunce of DNA binding domain of ZF7-VPR-tPT2a-ZF5.3-VPR; 2

SEQ ID NO.: 239

CTGGAACCGGGGAAAAACCCTACAAGTGCCCGGAATGCGGCAAGAGCTTCTCGACCTCCGGGAACCTGACCGAGCACCAGCG

CACCCACACCGGAGAGAAACCGTACAAGTGCCCCGAATGCGGGAAATCGTTCTCAGACTCGGAACCTCAGGGTGCACCAGC

GGACCCACACGGGGAAAAGCCGTACAAATGCCCGGAGTGCGGGAAGTCATTCTCCCACAAGAACGCGCTGCAGAACCACCAA

AGAACCCACACCGGCGAAAAACCGTACAAGTGCCCCGAGTGCGGAAAGTCCTTCTCCCGCAACGACACCCTCACCGAACACCA

ACGCACCCACACCGGAGAAAAGCCCTACAAGTGCCCGGAATGCGGAAAGAGCTTCAGCCAGAGGGCCCACCTGGAAAGACACC

-continued

AGAGAACCCACACCGGCGAAAAGCCGTACAAATGCCCGGAGTGCGGGAAGTCCTTCAGCCGGTCAGACAAGCTGGTCCGCCAC

CAAAGGACCCACACAGGAGAAAAGCCCTACAAGTGCCCGGAATGCGGAAAATCGTTCAGCGACCCCGGACACCTGGTCCGGCA

CCAGAGGACCCACACCGGGGAGAAGCCGACCGGCAAAAAGACCTCA

>ZF5.3-VPR-tPT2a-ZF7-p300 protein

SEQ ID NO.: 180

MAPKKKRKVGIHGVPAAGSSGSSGSLEPGEKPYKCPECGKSFSTSGNLTEHQRTHTGEKPYKCPECGKSFSDSGNLRVHQRTH

TGEKPYKCPECGKSFSHKNALQNHQRTHTGEKPYKCPECGKSFSRNDTLTEHQRTHTGEKPYKCPECGKSFSQRAHLERHQRT

HTGEKPYKCPECGKSFSRSDKLVRHQRTHTGEKPYKCPECGKSFSDPGHLVRHQRTHTGEKPTGKKTSASGSGGGSGGDALDD

FDLDMLGSDALDDFDLDMLGSDALDDFDLDMLGSDALDDFDLDMLSGGPKKKRKVGSQYLPDTDDRHRIEEKRKRTYETFKSI

MKKSPFSGPTDPRPPPRRIAVPSRSSASVPKPAPQPYPFTSSLSTINYDEFPTMVFPSGQISQASALAPAPPQVLPQAPAPAP

APAMVSALAQAPAPVPVLAPGPPQAVAPPAPKPTQAGEGTLSEALLQLQFDDEDLGALLGNSTDPAVFTDLASVDNSEFQQLL

NQGIPVAPHTTEPMLMEYPEAITRLVTGAQRPPDPAPAPLGAPGLPNGLLSGDEDFSSIADMDFSALLGSGSGSRDSREGMFL

PKPEAGSAISDVFEGREVCQPKRLRPFHPPGSPWANRPLPASLAPTPTGPVHEPVGSLTPAPVPQPLDPAPAVTPEASHLLED

PDEETSQAVKALREMADTVIPQKEEAAICGQMDLSHPPPRGHLDELTTTLESMTEDLNLDSPLTPELNEILDTFLNDECLLHA

MHISTGLSIFDTSLFSGGKRPAATKKAGQAKKKKGSYPYDVPDYAATNFSLLKQAGDVEENPGPTSAGKLGSGEGRGSLLTCG

DVEENPGPLEGSSGSGSLEPGEKPYKCPECGKSFSRSDHLTNHQRTHTGEKPYKCPECGKSFSTSGSLVRHQRTHTGEKPYKC

PECGKSFSQAGHLASHQRTHTGEKPYKCPECGKSFSRSDKLTEHQRTHTGEKPYKCPECGKSFSTSGNLTEHQRTHTGEKPYK

CPECGKSFSQSSNLVRHQRTHTGEKPYKCPECGKSFSTHLDLIRHQRTHTGEKPTGKKTSASGSGGGSGGIFKPEELRQALMP

TLEALYRQDPESLPFRQPVDPQLLGIPDYFDIVKSPMDLSTIKRKLDTGQYQEPWQYVDDIWLMFNNAWLYNRKTSRVYKYCS

KLSEVFEQEIDPVMQSLGYCCGRKLEFSPQTLCCYGKQLCTIPRDATYYSYQNRYHFCEKCFNEIQGESVSLGDDPSQPQTTI

NKEQFSKRKNDTLDPELFVECTECGRKMHQICVLHHEIIWPAGFVCDGCLKKSARTRKENKFSAKRLPSTRLGTFLENRVNDF

LRRQNHPESGEVTVRVVHASDKTVEVKPGMKARFVDSGEMAESFPYRTKALFAFEEIDGVDLCFFGMHVQEYGSDCPPPNQRR

VYISYLDSVHFFRPKCLRTAVYHEILIGYLEYVKKLGYTTGHIWACPPSEGDDYIFHCHPPDQKIPKPKRLQEWYKKMLDKAV

SERIVHDYKDIFKQATEDRLTSAKELPYFEGDFWPNVLEESIKELEQEEEERKREENTSNESTDVTKGDSKNAKKKNNKKTSK

NKSSLSRGNKKKPGMPNVSNDLSQKLYATMEKHKEVFFVIRLIAGPAANSLPPIVDPDPLIPCDLMDGRDAFLTLARDKHLEF

SSLRRAQWSTMCMLVELHTQSQDSGGKRPAATKKAGQAKKKKGSYPYDVPDYA*

>ZE5.3-VPR-tPT2a-ZE7-p300 mRNA

SEQ ID NO.: 181

AGGAAAUAAGAGAGAAAAGAAGAGUAAGAAGAAAUAUAAGAGCCACCAUGGCCCCCAAGAAGAAGCGGAAGGUGGGCAUCCAC

GGCGUGCCCGCCGCCGGCAGCAGCGGAUCAUCAGGCUCACUGGAACCGGGGGAAAAACCCUACAAGUGCCCGGAAUGCGGCAA

GAGCUUCUCGACCUCCGGGAACCUGACCGAGCACCAGCGCACCCACACCGGAGAGAAACCGUACAAGUGCCCCGAAUGCGGGA

AAUCGUUCUCAGACUCGGGAAACCUCAGGGUGCACCAGCGGACCCACACGGGGAAAAAGCCGUACAAAUGCCCGGAGUGCGGG

AAGUCAUUCUCCCACAAGAACGCGCUGCAGAACCACCAAAGAACCCACACCGGCGAAAAACCGUACAAGUGCCCCGAGUGCGG

AAAGUCCUUCUCCCGCAACGACACCCUCACCGAACACCAACGCACCCACACCGGAGAAAAGCCCUACAAGUGCCCGGAAUGCG

GAAAGAGCUUCAGCCAGAGGGCCCACCUGGAAAGACACCAGAGAACCCACACCGGCGAAAAGCCGUACAAAUGCCCGGAGUGC

GGGAAGUCCUUCAGCCGGUCAGACAAGCUGGUCCGCCACCAAAGGACCCACACAGGAGAAAAGCCCUACAAGUGCCCGGAAUG

CGGAAAAUCGUUCAGCGACCCCGGACACCUGGUCCGGCACCAGAGGACCCACACCGGGGAGAAGCCGACCGGCAAAAAGACCU

CAGCGAGCGGAUCAGGAGGAGGAUCAGGGGGGACGCACUGGACGACUUCGACCUGGACAUGCUGGGAUCAGACGCACUGGAC

GACUUCGACCUAGACAUGCUCGGAUCGGACGCACUCGACGACUUCGACCUCGACAUGCUAGGAUCAGACGCACUAGACGACUU

CGACCUCGACAUGCUGUCGGGAGGACCGAAGAAAAAGCGGAAGGUCGGAUCACAGUACCUCCCGGACACCGACGACAGGCACA

GAAUCGAAGAAAAACGCAAGCGCACCUACGAAACCUUCAAGAGCAUCAUGAAAAAGUCGCCGUUCUCAGGACCGACCGACCCC

AGACCGCCACCGAGGAGAAUAGCCGUCCCGAGCCGAUCCUCCGCAUCCGUGCCGAAACCGGCACCGCAACCCUACCCGUUCAC

-continued

CUCGUCCCUGUCGACCAUCAACUACGACGAGUUCCCCACCAUGGUGUUCCCCUCCGGGCAGAUCUCACAGGCCUCGGCACUGG

CACCCGCACCACCGCAAGUGCUGCCCCAAGCACCGGCACCCGCACCGGCGCCCGCAAUGGUGUCAGCGCUGGCACAGGCACCA

GCACCGGUGCCAGUCCUCGCACCGGGACCGCCGCAAGCAGUGGCACCGCCGGCACCGAAACCGACCCAGGCCGGAGAAGGGAC

CCUGUCCGAGGCGCUGCUGCAACUCCAGUUCGACGACGAGGACCUGGGAGCACUCCUGGGAAACUCCACCGACCCGGCAGUGU

UCACCGACCUCGCAUCGGUGGACAACUCCGAGUUCCAACAGCUCCUGAACCAGGGGAUACCGGUGGCACCGCACACCACCGAA

CCGAUGCUGAUGGAAUACCCGGAAGCCAUCACCCGGCUCGUGACCGGAGCGCAAAGACCGCCCGACCCCGCGCCCGCACCGCU

GGGAGCACCGGGACUACCGAACGGGCUGCUCUCAGGGGACGAGGACUUCUCCAGCAUCGCAGACAUGGACUUCUCCGCCCUGC

UGGGAUCAGGAUCAGGAUCACGCGACUCCCGGGAAGGAAUGUUCCUGCCGAAGCCGGAAGCAGGCAGCGCAAUCUCCGACGUG

UUCGAAGGCCGCGAGGUCUGCCAGCCCAAGCGCCUGCGACCGUUCCACCCGCCGGGAUCACCGUGGGCAAACCGCCCGCUACC

GGCAUCACUGGCACCGACACCCACCGGACCGGUGCACGAACCGGUCGGGUCACUGACCCCCGCACCGGUCCCGCAACCGCUAG

ACCCGGCACCGGCAGUGACCCCGGAAGCAUCGCACCUCCUGGAGGACCCGGACGAGGAAACCUCACAGGCAGUGAAGGCCCUG

CGGGAGAUGGCCGACACCGUGAUACCGCAGAAGGAGGAGGCCGCCAUCUGCGGACAAAUGGACCUGUCACACCCGCCCCCGAG

AGGACACCUGGACGAACUCACCACCACCCUGGAGAGCAUGACCGAGGACCUGAACCUGGACUCACCGCUGACCCCGGAGCUGA

ACGAAAUCCUGGACACCUUCCUGAACGACGAGUGCCUGCUGCACGCAAUGCACAUCAGCACCGGGCUGUCGAUCUUCGACACC

AGCCUGUUCUCCGGAGGGAAAAGACCCGCCGCCACCAAGAAAGCGGGCCAAGCAAAGAAAAAGAAGGGAUCGUACCCCUACGA

CGUGCCGGACUACGCAGCCACCAACUUUUCUCUGCUGAAGCAAGCCGGAGAUGUGGAGGAGAAUCCCGGCCCUACCUCCGCCG

GAAAACUGGGCUCCGGCGAAGGCAGAGGAAGCCUCCUCACAUGCGGCGACGUGGAGGAGAACCCCGGCCCUCUGGAGGGAUCC

UCAGGCUCAGGAUCCCUGGAACCGGGCGAGAAGCCAUACAAGUGCCCAGAGUGCGGCAAAAGCUUCAGCCGCAGCGACCAUCU

GACCAAUCACCAACGCACCCAUACCGGUGAGAAGCCGUACAAAUGCCAGAGUGCGGUAAGAGCUUUAGUACCAGUGGCAGUC

UGGUUCGUCAUCAGCGCACGCACACGGGCGAAAAACCAUACAAAUGCCCGGAGUGCGGCAAAAGCUUUAGCCAAGCCGGUCAU

CUGGCGAGCCAUCAACGUACGCACACCGGCGAGAAGCCGUAUAAAUGUCCGGAGUGCGGUAAGAGCUUUAGCCGUAGCGAUAA

ACUGACCGAACACCAACGUACGCAUACGGGCGAGAAACCAUAUAAAUGUCCAGAGUGUGGCAAGAGUUUCAGCACCAGCGGCA

AUCUGACCGAGCAUCAACGUACCCAUACCGGUGAAAAGCCAUAUAAAUGUCCAGAAUGCGGUAAGAGUUUUAGUCAGAGCAGU

AAUCUGGUGCGCCAUCAGCGUACCCACACGGGUGAGAAACCAUAUAAGUGUCCGGAAUGCGGCAAGAGUUUUAGCACCCAUCU

GGAUCUGAUCCGUCAUCAGCGCACCCACACCGGUGAAAAACCAACCGGCAAGAAAACCAGUGCUAGCGGCAGCGGCGGCGGCA

GCGGCGGCAUCUUCAAGCCCGAGGAGCUGCGGCAGGCCCUGAUGCCCACCCUGGAGGCCCUGUACCGGCAGGACCCCGAGAGC

CUGCCCUUCCGGCAGCCCGUGGACCCCCAGCUGCUGGGCAUCCCCGACUACUUCGACAUCGUGAAAUCCCCCAUGGACCUGAG

CACCAUCAAGCGGAAGCUGGACACCGGCCAGUACCAGGAGCCCUGGCAGUACGUGGACGACAUCUGGCUGAUGUUCAACAACG

CCUGGCUGUACAACCGGAAAACCAGCCGGGUGUACAAGUACUGCAGCAAGCUGAGCGAGGUGUUCGAGCAGGAGAUCGACCCC

GUGAUGCAGAGCCUGGGCUACUGCUGCGGCCGGAAGCUGGAGUUCAGCCCCCAGACCCUGUGCUGCUACGGCAAGCAGCUGUG

CACCAUCCCCCGGGACGCCACCUACUACAGCUACCAGAACCGGUACCACUUCUGCGAGAAGUGCUUCAACGAGAUCCAGGGCG

AGAGCGUGAGCCUGGGCGACGACCCCAGCCAGCCCCAGACCACCAUCAACAAGGAGCAGUUCAGCAAGCGGAAGAACGACACC

CUGGACCCCGAGCUGUUCGUGGAGUGCACCGAGUGCGGCCGGAAGAUGCACCAGAUCUGCGUGCUGCACCACGAGAUCAUCUG

GCCCGCCGGCUUCGUGUGCGACGGCUGCCUGAAGAAAUCCGCCCGGACCCGGAAGGAGAACAAGUUCAGCGCCAAGCGGCUGC

CCAGCACCCGGCUGGGCACCUUCCUGGAGAACCGGGUGAACGACUUCCUGCGGCGGCAGAACCACCCCGAGAGCGGCGAGGUG

ACCGUGCGGGUGGUGCACGCCAGCGACAAGACCGUGGAGGUGAAGCCCGGCAUGAAGGCCCGGUUCGUGGACAGCGGCGAGAU

GGCCGAGAGCUUCCCCUACCGGACCAAGGCCCUGUUCGCCUUCGAGGAGAUCGACGGCGUGGACCUGUGCUUCUUCGGCAUGC

ACGUGCAGGAGUACGGCAGCGACUGCCCCCCCCCCAACCAGCGGCGGGUGUACAUCAGCUACCUGGACAGCGUGCACUUCUUC

CGGCCCAAGUGCCUGCGGACCGCCGUGUACCACGAGAUCCUGAUCGGCUACCUGGAGUACGUGAAGAAGCUGGGCUACACCAC

CGGCCACAUCUGGGCCUGCCCCCCCAGCGAGGGCGACGACUACAUCUUCCACUGCCACCCCCCCGACCAGAAGAUCCCCAAGC

CCAAGCGGCUGCAGGAGUGGUACAAGAAGAUGCUGGACAAGGCCGUGAGCGAGCGGAUCGUGCACGACUACAAGGACAUCUUC

-continued

AAGCAGGCCACCGAGGACCGGCUGACCAGCGCCAAGGAGCUGCCCUACUUCGAGGGCGACUUCUGGCCCAACGUGCUGGAGGA

GAGCAUCAAGGAGCUGGAGCAGGAGGAGGAGGAGCGGAAGCGGGAGGAGAACACCAGCAACGAGAGCACCGACGUGACCAAGG

GCGACAGCAAGAACGCCAAGAAGAAGAACAACAAGAAAACCAGCAAGAACAAGAGCAGCCUGAGCCGGGGCAACAAGAAGAAG

CCCGGCAUGCCCAACGUGAGCAACGACCUGAGCCAGAAGCUGUACGCCACCAUGGAGAAGCACAAGGAGGUGUUCUUCGUGAU

CCGGCUGAUCGCCGGCCCCGCCGCCAACAGCCUGCCCCCCAUCGUGGACCCCGACCCCUGAUCCCCUGCGACCUGAUGGACG

GCCGGGACGCCUUCCUGACCCUGGCCCGGGACAAGCACCUGGAGUUCAGCAGCCUGCGGCGGGCCCAGUGGAGCACCAUGUGC

AUGCUGGUGGAGCUGCACACCCAGAGCCAGGACAGCGGCGGCAAGCGGCCCGCCGCCACCAAGAAGGCCGGCCAGGCCAAGAA

GAAGAAGGGCAGCUACCCCUACGACGUGCCCGACUACGCCUGAGCGGCCGCUUAAUUAAGCUGCCUUCUGCGGGGCUUGCCUU

CUGGCCAUGCCCUUCUUCUCUCCCUUGCACCUGUACCUCUUGGUCUUUGAAUAAAGCCUGAGUAGGAAGUCUAGAAAAAAAAA

AAAAAAAAAAAAAAAAAAAAAAAAAAAAAAAAAAAAAAAAAAAAAAAAAAAAAAAAAAAAAAAA

>Nucleotide Seqeunce of DNA binding domain of ZF5.3-VPR-tPT2a-ZF7-p300; 1

SEQ ID NO.: 240

CUGGAACCGGGGGAAAAACCCUACAAGUGCCCGGAAUGCGGCAAGAGCUUCUCGACCUCCGGGAACCUGACCGAGCACCAGCG

CACCCACACCGGAGAGAAACCGUACAAGUGCCCCGAAUGCGGGAAAUCGUUCUCAGACUCGGGAAACCUCAGGGUGCACCAGC

GGACCCACACGGGGGAAAAGCCGUACAAAUGCCCGGAGUGCGGGAAGUCAUUCUCCCCACAAGAACGCGCUGCAGAACCACCAA

AGAACCCACACCGGCGAAAAACCGUACAAGUGCCCCGAGUGCGGAAAGUCCUUCUCCCGCAACGACACCCUCACCGAACACCA

ACGCACCCACACCGGAGAAAAGCCCUACAAGUGCCCGGAAUGCGGAAAGAGCUUCAGCCAGAGGGCCCACCUGGAAAGACACC

AGAGAACCCACACCGGCGAAAAGCCGUACAAAUGCCCGGAGUGCGGGAAGUCCUUCAGCCGGUCAGACAAGCUGGUCCGCCAC

CAAAGGACCCACACAGGAGAAAAGCCCUACAAGUGCCCGGAAUGCGGAAAAUCGUUCAGCGACCCCGGACACCUGGUCCGGCA

CCAGAGGACCCACACCGGGGAGAAGCCGACCGGCAAAAAGACCUCA

>Nucleotide Seqeunce of DNA binding domain of ZF5.3-VPR-tPT2a-ZF7-p300; 2

SEQ ID NO.: 241

CTGGAACCGGGCGAGAAGCCATACAAGTGCCCAGAGTGCGGCAAAAGCTTCAGCCGCAGCGACCATCTGACCAATCACCAACG

CACCCATACCGGTGAGAAGCCGTACAAATGCCCAGAGTGCGGTAAGAGCTTTAGTACCAGTGGCAGTCTGGTTCGTCATCAGC

GCACGCACACGGGCGAAAAACCATACAAATGCCCGGAGTGCGGCAAAAGCTTTAGCCAAGCCGGTCATCTGGCGAGCCATCAA

CGTACGCACACCGGCGAGAAGCCGTATAAATGTCCGGAGTGCGGTAAGAGCTTTAGCCGTAGCGATAAACTGACCGAACACCA

ACGTACGCATACGGGCGAGAAACCATATAAATGTCCAGAGTGTGGCAAGAGTTTCAGCACCAGCGGCAATCTGACCGAGCATC

AACGTACCCATACCGGTGAAAAGCCATATAAATGTCCAGAATGCGGTAAGAGTTTTAGTCAGAGCAGTAATCTGGTGCGCCAT

CAGCGTACCCACACGGGTGAGAAACCATATAAGTGTCCGGAATGCGGCAAGAGTTTTAGCACCCATCTGGATCTGATCCGTCA

TCAGCGCACCCACACCGGTGAAAAACCAACCGGCAAGAAAACCAGT

>ZF7-p300-tPT2a-ZF5.3-VPR protein

SEQ ID NO.: 182

MAPKKKRKVGIHGVPAAGSSGSLEPGEKPYKCPECGKSFSRSDHLTNHQRTHTGEKPYKCPECGKSFSTSGSLVRHQRTHTGE

KPYKCPECGKSFSQAGHLASHQRTHTGEKPYKCPECGKSFSRSDKLTEHQRTHTGEKPYKCPECGKSFSTSGNLTEHQRTHTG

EKPYKCPECGKSFSQSSNLVRHQRTHTGEKPYKCPECGKSFSTHLDLIRHQRTHTGEKPTGKKTSASGSGGGSGGIFKPEELR

QALMPTLEALYRQDPESLPFRQPVDPQLLGIPDYFDIVKSPMDLSTIKRKLDTGQYQEPWQYVDDIWLMFNNAWLYNRKTSRV

YKYCSKLSEVFEQEIDPVMQSLGYCCGRKLEFSPQTLCCYGKQLCTIPRDATYYSYQNRYHFCEKCFNEIQGESVSLGDDPSQ

PQTTINKEQFSKRKNDTLDPELFVECTECGRKMHQICVLHHEIIWPAGFVCDGCLKKSARTRKENKFSAKRLPSTRLGTFLEN

RVNDFLRRQNHPESGEVTVRVVHASDKTVEVKPGMKARFVDSGEMAESFPYRTKALFAFEEIDGVDLCFFGMHVQEYGSDCPP

PNQRRVYISYLDSVHFFRPKCLRTAVYHEILIGYLEYVKKLGYTTGHIWACPPSEGDDYIFHCHPPDQKIPKPKRLQEWYKKM

LDKAVSERIVHDYKDIFKQATEDRLTSAKELPYFEGDFWPNVLEESIKELEQEEEERKREENTSNESTDVTKGDSKNAKKKNN

KKTSKNKSSLSRGNKKKPGMPNVSNDLSQKLYATMEKHKEVFFVIRLIAGPAANSLPPIVDPDPLIPCDLMDGRDAFLTLARD

KHLEFSSLRRAQWSTMCMLVELHTQSQDSGGKRPAATKKAGQAKKKKGSYPYDVPDYAATNFSLLKQAGDVEENPGPTSAGKL

-continued

GSGEGRGSLLTCGDVEENPGPLEGSSGSLEPGEKPYKCPECGKSFSTSGNLTEHQRTHTGEKPYKCPECGKSFSDSGNLRVHQ

RTHTGEKPYKCPECGKSFSHKNALQNHQRTHTGEKPYKCPECGKSFSRNDTLTEHQRTHTGEKPYKCPECGKSFSQRAHLERH

QRTHTGEKPYKCPECGKSFSRSDKLVRHQRTHTGEKPYKCPECGKSFSDPGHLVRHQRTHTGEKPTGKKTSASGSGGGSGGDA

LDDFDLDMLGSDALDDFDLDMLGSDALDDFDLDMLGSDALDDFDLDMLGGPKKKRKVGSQYLPDTDDRHRIEEKRKRTYETF

KSIMKKSPFSGPTDPRPPPRRIAVPSRSSASVPKPAPQPYPFTSSLSTINYDEFPTMVFPSGQISQASALAPAPPQVLPQAPA

PAPAPAMVSALAQAPAPVPVLAPGPPQAVAPPAPKPTQAGEGTLSEALLQLQFDDEDLGALLGNSTDPAVFTDLASVDNSEFQ

QLLNQGIPVAPHTTEPMLMEYPEAITRLVTGAQRPPDPAPAPLGAPGLPNGLLSGDEDFSSIADMDFSALLGSGSGSRDSREG

MFLPKPEAGSAISDVFEGREVCQPKRLRPFHPPGSPWANRPLPASLAPTPTGPVHEPVGSLTPAPVPQPLDPAPAVTPEASHL

LEDPDEETSQAVKALREMADTVIPQKEEAAICGQMDLSHPPPRGHLDELTTTLESMTEDLNLDSPLTPELNEILDTFLNDECL

LHAMHISTGLSIFDTSLFSGGKRPAATKKAGQAKKKKGSYPYDVPDYA*

>>ZF7-p300-tPT2a-ZF5.3-VPR mRNA

SEQ ID NO.: 183

AGGAAAUAAGAGAGAAAAGAAGAGUAAGAAGAAAUAUAAGAGCCACCAUGGCCCCCAAGAAGAAGCGGAAGGUGGGCAUCCAC

GGCGUGCCCGCCGCCGGCAGCAGCGGAUCCCUGGAACCGGGCGAGAAGCCAUACAAGUGCCCAGAGUGCGGCAAAAGCUUCAG

CCGCAGCGACCAUCUGACCAAUCACCAACGCACCCAUACCGGUGAGAAGCCAUACAAAUGCCCAGAGUGCGGUAAGAGCUUUA

GUACCAGUGGCAGUCUGGUUCGUCAUCAGCGCACGCACACGGGCGAAAAACCAUACAAAUGCCCGGAGUGCGGCAAAAGCUUU

AGCCAAGCCGGUCAUCUGGCGAGCCAUCAACGUACGCACACCGGCGAGAAGCCGUAUAAAUGUCCGGAGUGCGGUAAGAGCUU

UAGCCGUAGCGAUAAACUGACCGAACACCAACGUACGCAUACGGGCGAGAAACCAUAUAAAUGUCCAGAGUGUGGCAAGAGUU

UCAGCACCAGCGGCAAUCUGACCGAGCAUCAACGUACCCAUACCGGUGAAAAGCCAUAUAAAUGUCCAGAAUGCGGUAAGAGU

UUUAGUCAGAGCAGUAAUCUGGUGCGCCAUCAGCGUACCCACACGGGUGAGAAACCAUAUAAGUGUCCGGAAUGCGGCAAGAG

UUUUAGCACCCAUCUGGAUCUGAUCCGUCAUCAGCGCACCCACACCGGUGAAAAACCAACCGGCAAGAAAACCAGUGCUAGCG

GCAGCGGCGGCGGCAGCGGCGGCAUCUUCAAGCCCGAGGAGCUGCGGCAGGCCCUGAUGCCCACCCUGGAGGCCCUGUACCGG

CAGGACCCCGAGAGCCUGCCCUUCCGGCAGCCCGUGGACCCCCAGCUGCUGGGCAUCCCCGACUACUUCGACAUCGUGAAAUC

CCCCAUGGACCUGAGCACCAUCAAGCGGAAGCUGGACACCGGCCAGUACCAGGAGCCCUGGCAGUACGUGGACGACAUCUGGC

UGAUGUUCAACAACGCCUGGCUGUACAACCGGAAAACCAGCCGGGUGUACAAGUACUGCAGCAAGCUGAGCGAGGUGUUCGAG

CAGGAGAUCGACCCCGUGAUGCAGAGCCUGGGCUACUGCUGCGGCCGGAAGCUGGAGUUCAGCCCCCAGACCCCGUGCUGCUA

CGGCAAGCAGCUGUGCACCAUCCCCCGGGACGCCACCUACUACAGCUACCAGAACCGGUACCACUUCUGCGAGAAGUGCUUCA

ACGAGAUCCAGGGCGAGAGCGUGAGCCUGGGCGACGACCCCAGCCAGCCCCAGACCACCAUCAACAAGGAGCAGUUCAGCAAG

CGGAAGAACGACACCCUGGACCCCGAGCUGUUCGUGGAGUGCACCGAGUGCGGCCGGAAGAUGCACCAGAUCUGCGUGCUGCA

CCACGAGAUCAUCUGGCCCGCCGGCUUCGUGUGCGACGGCUGCCUGAAGAAAUCCGCCCGGACCCGGAAGGAGAACAAGUUCA

GCGCCAAGCGGCUGCCCAGCACCCGGCUGGGCACCUUCCUGGAGAACCGGGUGAACGACUUCCUGCGGCGGCAGAACCACCCC

GAGAGCGGCGAGGUGACCGUGCGGGUGGUGCACGCCAGCGACAAGACCUGGGAGGUGAAGCCCGGCAUGAAGGCCCGGUUCGU

GGACAGCGGCGAGAUGGCCGAGAGCUUCCCCUACCGGACCAAGGCCCUGUUCGCCUUCGAGGAGAUCGACGGCGUGGACCUGU

GCUUCUUCGGCAUGCACGUGCAGGAGUACGGCAGCGACUGCCCCCCCCCCAACCAGCGGCGGGUGUACAUCAGCUACCUGGAC

AGCGUGCACUUCUUCCGGCCCAAGUGCCUGCGGACCGCCGUGUACCACGAGAUCCUGAUCGGCUACCUGGAGUACGUGAAGAA

GCUGGGCUACACCACCGGCCACAUCUGGGCCUGCCCCCCAGCGAGGGCGACGACUACAUCUUCCACUGCCACCCCCCCGACC

AGAAGAUCCCCAAGCCCAAGCGGCUGCAGGAGUGGUACAAGAAGAUGCUGGACAAGGCCGUGAGCGAGCGGAUCGUGCACGAC

UACAAGGACAUCUUCAAGCAGGCCACCGAGGACCGGCUGACCAGCGCCAAGGAGCUGCCCUACUUCGAGGGCGACUUCUGGCC

CAACGUGCUGGAGGAGAGCAUCAAGGAGCUGGAGCAGGAGGAGGAGGAGCGGAAGCGGGAGGAGAACACCAGCAACGAGAGCA

CCGACGUGACCAAGGGCGACAGCAAGAACGCCAAGAAGAAGAACAACAAGAAAACCAGCAAGAACAAGAGCAGCCUGAGCCGG

GGCAACAAGAAGAAGCCCGGCAUGCCCAACGUGAGCAACGACCUGAGCCAGAAGCUGUACGCCACCAUGGAGAAGCACAAGGA

GGUGUUCUUCGUGAUCCGGCUGAUCGCCGGCCCCGCCGCCAACAGCCUGCCCCCCAUCGUGGACCCCGACCCCCUGAUCCCCU

-continued

```
GCGACCUGAUGGACGGCCGGGACGCCUUCCUGACCCUGGCCCGGGACAAGCACCUGGAGUUCAGCAGCCUGCGGCGGGCCCAG

UGGAGCACCAUGUGCAUGCUGGUGGAGCUGCACACCCAGAGCCAGGACAGCGGCGGCAAGCGGCCCGCCGCCACCAAGAAGGC

CGGCCAGGCCAAGAAGAAGAAGGGCAGCUACCCCUACGACGUGCCCGACUACGCCGCCACCAACUUUUCUCUGCUGAAGCAAG

CCGGAGAUGUGGAGGAGAAUCCCGGCCCUACCUCCGCCGGAAAACUGGGCUCCGGCGAAGGCAGAGGAAGCCUCCUCACAUGC

GGCGACGUGGAGGAGAACCCCGGCCCUCUGGAGGGAUCCUCAGGCUCACUGGAACCGGGGAAAAACCCUACAAGUGCCCGGA

AUGCGGCAAGAGCUUCUCGACCUCCGGGAACCUGACCGAGCACCAGCGCACCCACACCGGAGAGAAACCGUACAAGUGCCCCG

AAUGCGGGAAAUCGUUCUCAGACUCGGGAAACCUCAGGGUGCACCAGCGGACCCACACGGGGGAAAAGCCGUACAAAUGCCCG

GAGUGCGGGAAGUCAUUCUCCCACAAGAACGCGCUGCAGAACCACCAAAGAACCCACACCGGCGAAAAACCGUACAAGUGCCC

CGAGUGCGGAAAGUCCUUCUCCCGCAACGACACCCUCACCGAACACCAACGCACCCACACCGGAGAAAAGCCCUACAAGUGCC

CGGAAUGCGGAAAGAGCUUCAGCCAGAGGGCCCACCUGGAAAGACACCAGAGAACCCACACCGGCGAAAAGCCGUACAAAUGC

CCGGAGUGCGGGAAGUCCUUCAGCCGGUCAGACAAGCUGGUCCGCCACCAAAGGACCCACACAGGAGAAAAGCCCUACAAGUG

CCCGGAAUGCGGAAAAUCGUUCAGCGACCCCGGACACCUGGUCCGGCACCAGAGGACCCACACCGGGGAGAAGCCGACCGGCA

AAAAGACCUCAGCGAGCGGAUCAGGAGGAGGAUCAGGGGGGGACGCACUGGACGACUUCGACCUGGACAUGCUGGGAUCAGAC

GCACUGGACGACUUCGACCUAGACAUGCUCGGAUCGGACGCACUCGACGACUUCGACCUCGACAUGCUAGGAUCAGACGCACU

AGACGACUUCGACCUCGACAUGCUGUCGGAGGACCGAAGAAAAAGCGGAAGGUCGGAUCACAGUACCUCCCGGACACCGACG

ACAGGCACAGAAUCGAAGAAAAACGCAAGCGCACCUACGAAACCUUCAAGAGCAUCAUGAAAAAGUCGCCGUUCUCAGGACCG

ACCGACCCCAGACCGCCACCGAGGAGAAUAGCCGUCCCGAGCCGAUCCUCCGCAUCCGUGCCGAAACCGGCACCGCAACCCUA

CCCGUUCACCUCGUCCCUGUCGACCAUCAACUACGACGAGUUCCCCACCAUGGUGUUCCCCUCCGGGCAGAUCUCACAGGCCU

CGGCACUGGCACCCGCACCACCGCAAGUGCUGCCCCAAGCACCGGCACCCGCACCGGCGCCCGCAAUGGUGUCAGCGCUGGCA

CAGGCACCAGCACCGGUGCCAGUCCUCGCACCGGGACCGCCGCAAGCAGUGGCACCGCCGGCACCGAAACCGACCCAGGCCGG

AGAAGGGACCCUGUCCGAGGCGCUGCUGCAACUCCAGUUCGACGACGAGGACCUGGGAGCACUCCUGGGAAACUCCACCGACC

CGGCAGUGUUCACCGACCUCGCAUCGGUGGACAACUCCGAGUUCCAACAGCUCCUGAACCAGGGGAUACCGGUGGCACCGCAC

ACCACCGAACCGAUGCUGAUGGAAUACCCGGAAGCCAUCACCCGGCUCGUGACCGGAGCGCAAAGACCGCCCGACCCCGCGCC

CGCACCGCUGGGAGCACCGGGACUACCGAACGGGCUGCUCUCAGGGGACGAGGACUUCUCCAGCAUCGCAGACAUGGACUUCU

CCGCCCUGCUGGGAUCAGGAUCAGGAUCACGCGACUCCCGGGAAGGAAUGUUCCUGCCGAAGCCGGAAGCAGGCAGCGCAAUC

UCCGACGUGUUCGAAGGCCGCGAGGUCUGCCAGCCCAAGCGCCUGCGACCGUUCCACCCGCCGGGAUCACCGUGGGCAAACCG

CCCGCUACCGGCAUCACUGGCACCGACACCCACCGGACCGGUGCACGAACCGGUCGGUCACUGACCCCGCACCGGUCCCGC

AACCGCUAGACCCGGCACCGGCAGUGACCCCGGAAGCAUCGCACCUCCUGGAGGACCCGGACGAGGAAACCUCACAGGCAGUG

AAGGCCCUGCGGGAGAUGGCCGACACCGUGAUACCGCAGAAGGAGGAGGCCGCCAUCUGCGGACAAAUGGACCGUCACACCC

GCCCCCGAGAGGACACCUGGACGAACUCACCACCACCCUGGAGAGCAUGACCGAGGACCUGAACCUGGACUCACCGCUGACCC

CGGAGCUGAACGAAAUCCUGGACACCUUCCUGAACGACGAGUGCCUGCUGCACGCAAUGCACAUCAGCACCGGGCUGUCGAUC

UUCGACACCAGCCUGUUCUCCGGAGGGAAAAGACCCGCCGCCACCAAGAAAGCGGGCCAAGCAAAGAAAAAGAAGGGAUCGUA

CCCCUACGACGUGCCGGACUACGCAUGAGCGGCCGCUUAAUUAAGCUGCCUUCUGCGGGGCUUGCCUUCUGGCCAUGCCCUUC

UUCUCUCCCUUGCACCUGUACCUCUUGGUCUUUGAAUAAAGCCUGAGUAGGAAGUCUAGAAAAAAAAAAAAAAAAAAAAAAAA

AAAAAAAAAAAAAAAAAAAAAAAAAAAAAAAAAAAAAAAAAAAAAAAAAA

>Nucleotide Seqeunce of DNA binding domain of ZF7-p300-tPT2a-ZF5.3-VPR
                                                                    SEQ ID NO.: 242
CUGGAACCGGGCGAGAAGCCAUACAAGUGCCCAGAGUGCGGCAAAAGCUUCAGCCGCAGCGACCAUCUGACCAAUCACCAACG CACCCAUACCGGUGAGAAGCCGUACAAAUGCCCAGAGUGCGGUAAGAGCUUUAGUACCAGUGGCAGUCUGGUUCGUCAUCAGC GCACGCACACGGGCGAAAAACCAUACAAAUGCCCGGAGUGCGGCAAAAGCUUUAGCCAAGCCGGUCAUCUGGCGAGCCAUCAA CGUACGCACACCGGCGAGAAGCCGUAUAAAUGUCCGGAGUGCGGUAAGAGCUUUAGCCGUAGCGAUAAACUGACCGAACACCA
```

ACGUACGCAUACGGGCGAGAAACCAUAUAAAUGUCCAGAGUGUGGCAAGAGUUUCAGCACCAGCGGCAAUCUGACCGAGCAUC

AACGUACCCAUACCGGUGAAAAGCCAUAUAAAUGUCCAGAAUGCGGUAAGAGUUUUAGUCAGAGCAGUAAUCUGGUGCGCCAU

CAGCGUACCCACACGGGUGAGAAACCAUAUAAGUGUCCGGAAUGCGGCAAGAGUUUUAGCACCCAUCUGGAUCUGAUCCGUCA

UCAGCGCACCCACACCGGUGAAAAACCAACCGGCAAGAAAACCAGU

>Nucleotide Seqeunce of DNA binding domain of ZF7-p300-tPT2a-ZF5.3-VPR

SEQ ID NO.: 243

CTGGAACCGGGGGAAAAACCCTACAAGTGCCCGGAATGCGGCAAGAGCTTCTCGACCTCCGGGAACCTGACCGAGCACCAGCG

CACCCACACCGGAGAGAAACCGTACAAGTGCCCCGAATGCGGGAAATCGTTCTCAGACTCGGGAAACCTCAGGGTGCACCAGC

GGACCCACACGGGGAAAAGCCGTACAAATGCCCGGAGTGCGGGAAGTCATTCTCCCACAAGAACGCGCTGCAGAACCACCAA

AGAACCCACACCGGCGAAAAACCGTACAAGTGCCCCGAGTGCGGAAAGTCCTTCTCCCGCAACGACACCCTCACCGAACACCA

ACGCACCCACACCGGAGAAAAGCCCTACAAGTGCCCGGAATGCGGAAAGAGCTTCAGCCAGAGGGCCCACCTGGAAAGACACC

AGAGAACCCACACCGGCGAAAAGCCGTACAAATGCCCGGAGTGCGGGAAGTCCTTCAGCCGGTCAGACAAGCTGGTCCGCCAC

CAAAGGACCCACACAGGAGAAAAGCCCTACAAGTGCCCGGAATGCGGAAAATCGTTCAGCGACCCCGGACACCTGGTCCGGCA

CCAGAGGACCCACACCGGGGAGAAGCCGACCGGCAAAAAGACCTCA

>TAL1-VPR protein

SEQ ID NO.: 184

MAPKKKRKVGIHGVPAAGSSGSHMVDLRTLGYSQQQQEKIKPKVRSTVAQHHEALVGHGFTHAHIVALSQHPAALGTVAVKYQ

DMIAALPEATHEAIVGVGKRGAGARALEALLTVAGELRGPPLQLDTGQLLKIAKRGGVTAVEAVHAWRNALTGAPLNLTPEQV

VAIASHDGGKQALETVQRLLPVLCQAHGLTPEQVVAIASNNGGKQALETVQRLLPVLCQAHGLTPEQVVAIASNNGGKQALET

VQRLLPVLCQAHGLTPEQVVAIASHDGGKQALETVQRLLPVLCQAHGLTPEQVVAIASNNGGKQALETVQRLLPVLCQAHGLT

PEQVVAIASNNGGKQALETVQRLLPVLCQAHGLTPEQVVAIASNNGGKQALETVQRLLPVLCQAHGLTPEQVVAIASNNGGKQ

ALETVQRLLPVLCQAHGLTPEQVVAIASNIGGKQALETVQRLLPVLCQAHGLTPEQVVAIASNNGGKQALETVQRLLPVLCQA

HGLTPEQVVAIASNNGGKQALETVQRLLPVLCQAHGLTPEQVVAIASHDGGKQALETVQRLLPVLCQAHGLTPEQVVAIASNI

GGKQALETVQRLLPVLCQAHGLTPEQVVAIASNNGGKQALETVQRLLPVLCQAHGLTPEQVVAIASNNGGKQALETVQRLLPV

LCQAHGLTPEQVVAIASNNGGKQALETVQRLLPVLCQAHGLTPEQVVAIASNIGGKQALETVQRLLPVLCQAHGLTPEQVVAI

ASNNGGRPALESIVAQLSRPDPALAALTNDHLVALACLGGRPALDAVKKGLPHAPALIKRTNRRIPERTSHRVASGSGGSGG

DALDDFDLDMLGSDALDDFDLDMLGSDALDDFDLDMLGSDALDDFDLDMLSGGPKKKRKVGSQYLPDTDDRHRIEEKRKRTYE

TFKSIMKKSPFSGPTDPRPPPRRIAVPSRSSASVPKPAPQPYPFTSSLSTINYDEFPTMVFPSGQISQASALAPAPPQVLPQA

PAPAPAPAMVSALAQAPAPVPVLAPGPPQAVAPPAPKPTQAGEGTLSEALLQLQFDDEDLGALLGNSTDPAVFTDLASVDNSE

FQQLLNQGIPVAPHTTEPMLMEYPEAITRLVTGAQRPPDPAPAPLGAPGLPNGLLSGDEDFSSIADMDFSALLGSGSGSRDSR

EGMFLPKPEAGSAISDVFEGREVCQPKRLRPFHPPGSPWANRPLPASLAPTPTGPVHEPVGSLTPAPVPQPLDPAPAVTPEAS

HLLEDPDEETSQAVKALREMADTVIPQKEEAAICGQMDLSHPPPRGHLDELTTTLESMTEDLNLDSPLTPELNEILDTFLNDE

CLLHAMHISTGLSIFDTSLFSGGKRPAATKKAGQAKKKKGSYPYDVPDYA*

>TAL1-VPR mRNA

SEQ ID NO.: 185

AGGAAATAAGAGAGAAAAGAAGAGTAAGAAGAAATATAAGAGCCACCATGGCCCCCAAGAAGAAGCGGAAGGTGGGCATCCAC

GGCGTGCCCGCCGCCGGCAGCAGCGGATCCCATATGGTTGATCTGCGTACCCTGGGTTATAGCCAGCAGCAGCAAGAAAAAAT

CAAACCGAAAGTTCGTAGCACCGTTGCACAGCATCATGAAGCACTGGTTGGTCATGGTTTTACCCATGCACATATTGTTGCAC

TGAGCCAGCATCCGGCAGCACTGGGCACCGTTGCAGTTAAATATCAGGATATGATTGCAGCACTGCCGGAAGCAACCCATGAA

GCAATTGTTGGTGTTGGTAAACGCGGAGCTGGTGCACGTGCCCTGGAAGCACTGCTGACCGTTGCCGGTGAACTGCGTGGTCC

GCCTCTGCAGCTGGATACCGGTCAGCTGCTGAAAATTGCAAAACGTGGTGGTGTTACCGCAGTTGAAGCAGTTCATGCATGGC

GTAATGCACTGACCGGTGCACCGCTGAATCTGACACCGGAACAGGTTGTTGCAATTGCCAGCCATGATGGTGGCAAACAGGCA

CTGGAAACCGTTCAGCGTCTGCTGCCGGTTCTGTGTCAGGCACATGGTCTGACCCCTGAACAGGTGGTGGCCATTGCAAGCAA

TAATGGCGGTAAACAAGCCCTGGAAACAGTGCAGCGCCTGTTACCGGTGCTGTGCCAGGCCCATGGCTTAACTCCGGAACAGG

```
TGGTAGCGATCGCATCAAACAATGGAGGTAAACAGGCCTTAGAAACCGTACAGCGCTTACTGCCGGTGTTATGCCAGGCGCAC

GGCCTGACGCCAGAACAGGTAGTGGCAATCGCCTCACATGACGGTGGAAAACAGGCGTTAGAGACAGTCCAGCGCCTGCTGCC

TGTATTATGTCAAGCCCATGGCCTGACCCCAGAGCAAGTTGTTGCGATTGCAAGTAATAATGGGGGTAAACAGGCACTTGAGA

CAGTTCAACGTTTACTGCCTGTACTGTGCCAAGCTCACGGTCTGACTCCGGAACAAGTCGTCGCGATTGCGAGTAATGGTGGT

GGCAAACAAGCATTAGAAACGGTGCAACGCCTGCTGCCAGTTCTTTGCCAGGCTCACGGTTTAACCCCTGAGCAGGTTGTAGC

TATTGCGAGTAACAATGGTGGTAAGCAGGCGTTGGAAACTGTGCAAAGACTGCTGCCCGTGTTGTGCCAAGCACATGGTTTAA

CCCCAGAACAAGTCGTAGCAATCGCAAGCAATAATGGTGGCAAGCAAGCGCTTGAAACAGTACAGCGTTTATTACCGGTACTT

TGTCAGGCCCACGGTCTTACACCAGAACAAGTTGTGGCCATAGCCAGTAACATTGGCGGAAAGCAGGCTCTGGAAACGGTACA

ACGTCTGTTACCTGTTCTGTGTCAAGCGCACGGATTAACACCTGAACAAGTAGTTGCCATTGCGTCAAATAATGGAGGCAAGC

AGGCCTTGGAGACAGTGCAGAGATTACTGCCAGTGTTGTGTCAGGCTCATGGCCTTACACCCGAGCAGGTCGTGGCAATTGCA

TCTAACAATGGCGGTAAGCAAGCTTTAGAGACTGTTCAGAGACTGCTTCCTGTCCTGTGCCAGGCACACGGACTTACGCCTGA

GCAAGTGGTTGCAATCGCCTCTCATGATGGTGGTAAGCAAGCACTGGAAACTGTCCAACGCTTACTTCCGGTGCTTTGTCAAG

CACACGGCTTAACGCCAGAGCAGGTCGTCGCCATAGCCAGCAATATAGGTGGTAAACAGGCCCTTGAAACGGTCCAAAGACTT

CTGCCGGTCCTTTGCCAAGCGCATGGGCTGACACCTGAGCAGGTAGTCGCGATTGCCTCAAATAATGGTGGGAAGCAGGCATT

AGAAACAGTTCAAAGATTATTACCAGTCCTGTGTCAGGCGCATGGGTTAACCCCAGAGCAGGTAGTTGCAATAGCATCCAACA

ATGGCGGAAAACAAGCGTTGGAAACGGTTCAGCGGTTATTGCCTGTTTTGTGCCAGGCGCATGGTTTGACACCCGAGCAAGTG

GTAGCCATAGCCTCAAATAATGGGGGTAAACAAGCTTTGGAGACAGTACAACGGCTGCTTCCAGTTTTATGTCAGGCCCATGG

ATTGACGCCTGAACAAGTTGTCGCTATCGCAAGTAATATCGGTGGTAAACAAGCGCTTGAAACCGTTCAACGCCTTCTGCCTG

TGCTTTGTCAGGCACATGGATTAACACCCGAACAGGTTGTCGCGATAGCTTCAAACAATGGTGGTCGTCCGGCACTGGAAAGC

ATTGTTGCACAGCTGAGCCGTCCTGATCCGGCACTGGCAGCACTGACCAATGATCATCTGGTTGCACTGGCATGTCTGGGTGG

TCGCCCTGCCCTGGATGCAGTTAAAAAAGGTCTGCCGCATGCACCGGCACTGATTAAACGTACCAATCGTCGTATTCCGGAAC

GTACCAGCCATCGTGTTGCTAGCGGCAGCGGCGGCGGCAGCGGCGGCGACGCCCTGGACGACTTCGACCTGGACATGCTGGGC

AGCGACGCCCTGGACGACTTCGACCTGGACATGCTGGGCAGCGACGCCCTGGACGACTTCGACCTGGACATGCTGGGCAGCGA

CGCCCTGGACGACTTCGACCTGGACATGCTGAGCGGCGGCCCCAAGAAGAAGCGGAAGGTGGGCAGCCAGTACCTGCCCGACA

CCGACGACCGGCACCGGATCGAGGAGAAGCGGAAGCGGACCTACGAGACCTTCAAGAGCATCATGAAGAAATCCCCCTTCAGC

GGCCCCACCGACCCCGGCCCCCCCCCGGCGGATCGCCGTGCCCAGCCGGAGCAGCGCCAGCGTGCCCAAGCCCGCCCCCCA

GCCCTACCCCTTCACCAGCAGCCTGAGCACCATCAACTACGACGAGTTCCCCACCATGGTGTTCCCCAGCGGCCAGATCAGCC

AGGCCAGCGCCCTGGCCCCCGCCCCCCCCCAGGTGCTGCCCCAGGCCCCCGCCCCGCCCCCGCCCCGCCATGGTGAGCGCC

CTGGCCCAGGCCCCCGCCCCCGTGCCCGTGCTGGCCCCCGGCCCCCCCCAGGCCGTGGCCCCCCCCGCCCCCAAGCCCACCCA

GGCCGGCGAGGGCACCCTGAGCGAGGCCCTGCTGCAGCTGCAGTTCGACGACGAGGACCTGGGCGCCCTGCTGGGCAACAGCA

CCGACCCCGCCGTGTTCACCGACCTGGCCAGCGTGGACAACAGCGAGTTCCAGCAGCTGCTGAACCAGGGCATCCCCGTGGCC

CCCCACACCACCGAGCCCATGCTGATGGAGTACCCCGAGGCCATCACCCGGCTGGTGACCGGCGCCCAGCGGCCCCCCGACCC

CGCCCCCGCCCCCCTGGGCGCCCCCGGCCTGCCCAACGGCCTGCTGAGCGGCGACGAGGACTTCAGCAGCATCGCCGACATGG

ACTTCAGCGCCCTGCTGGGCAGCGGCAGCGGCAGCCGGGACAGCCGGGAGGGCATGTTCCTGCCCAAGCCCGAGGCCGGCAGC

GCCATCAGCGACGTGTTCGAGGGCCGGGAGGTGTGCCAGCCCAAGCGGCTCCGGCCCTTCCACCCCCCCGGCAGCCCCTGGGC

CAACCGGCCCCTGCCCGCCAGCCTGGCCCCCACCCCCACCGGCCCCGTGCACGAGCCCGTGGGCAGCCTGACCCCCGCCCCG

TGCCCCAGCCCCTGGACCCCGCCCCCGCCGTGACCCCGAGGCCAGCCACCTGCTGGAGGACCCCGACGAGGAGACCAGCCAG

GCCGTGAAGGCCCTGCGGGAGATGGCCGACACCGTGATCCCCCAGAAGGAGGAGGCCGCCATCTGCGGCCAGATGGACCTGAG

CCACCCCCCCCCCGGGGCCACCTGGACGAGCTGACCACCACCCTGGAGAGCATGACCGAGGACCTGAACCTGGACAGCCCCC

TGACCCCCGAGCTGAACGAGATCCTGGACACCTTCCTGAACGACGAGTGCCTGCTGCACGCCATGCACATCAGCACCGGCCTG
```

-continued

```
AGCATCTTCGACACCAGCCTGTTCAGCGGCGGCAAGCGGCCCGCCGCCACCAAGAAGGCCGGCCAGGCCAAGAAGAAGAAGGG
CAGCTACCCCTACGACGTGCCCGACTACGCCTGAGCGGCCGCTTAATTAAGCTGCCTTCTGCGGGGCTTGCCTTCTGGCCATG
CCCTTCTTCTCTCCCTTGCACCTGTACCTCTTGGTCTTTGAATAAAGCCTGAGTAGGAAGTCTAGAAAAAAAAAAAAAAAAAA
AAAAAAAAAAAAAAAAAAAAAAAAAAAAAAAAAAAAAAAAAAAAAAAAAAAAAAAAAAA
```

>TAL1 amino acid sequence
SEQ ID NO.: 186
```
GSHMVDLRTLGYSQQQQEKIKPKVRSTVAQHHEALVGHGFTHAHIVALSQHPAALGTVAVKYQDMIAALPEATHEAIVGVGKR
GAGARALEALLTVAGELRGPPLQLDTGQLLKIAKRGGVTAVEAVHAWRNALTGAPLULTPEQVVAIASHDGGKQALETVQRLL
PVLCQAHGLTPEQVVAIASUNGGKQALETVQRLLPVLCQAHGLTPEQVVAIASUNGGKQALETVQRLLPVLCQAHGLTPEQVV
AIASHDGGKQALETVQRLLPVLCQAHGLTPEQVVAIASUNGGKQALETVQRLLPVLCQAHGLTPEQVVAIASUGGGKQALETV
QRLLPVLCQAHGLTPEQVVAIASUNGGKQALETVQRLLPVLCQAHGLTPEQVVAIASUNGGKQALETVQRLLPVLCQAHGLTP
EQVVAIASNIGGKQALETVQRLLPVLCQAHGLTPEQVVAIASUNGGKQALETVQRLLPVLCQAHGLTPEQVVAIASUNGGKQA
LETVQRLLPVLCQAHGLTPEQVVAIASHDGGKQALETVQRLLPVLCQAHGLTPEQVVAIASNIGGKQALETVQRLLPVLCQAH
GLTPEQVVAIASUNGGKQALETVQRLLPVLCQAHGLTPEQVVAIASUNGGKQALETVQRLLPVLCQAHGLTPEQVVAIASNNG
GKQALETVQRLLPVLCQAHGLTPEQVVAIASNIGGKQALETVQRLLPVLCQAHGLTPEQVVAIASUNGGRPALESIVAQLSRP
DPALAALTNDHLVALACLGGRPALDAVKKGLPHAPALIKRTURRIPERTSHRVAS
```

>TAL1 mRNA
SEQ ID NO.: 244
```
GGAUCCCAUAUGGUUGAUCUGCGUACCCUGGGUUAUAGCCAGCAGCAGCAAGAAAAAAUCAAACCGAAAGUUCGUAGCACCGU
UGCACAGCAUCAUGAAGCACUGGUUGGUCAUGGUUUUACCCAUGCACAUAUUGUUGCACUGAGCCAGCAUCCGGCAGCACUGG
GCACCGUUGCAGUUAAAUAUCAGGAUAUGAUUGCAGCACUGCCGGAAGCAACCCAUGAAGCAAUUGUUGGUGUUGGUAAACGC
GGAGCUGGUGCACGUGCCCUGGAAGCACUGCUGACCGUUGCCGGUGAACUGCGUGGUCCGCCUCUGCAGCUGGAUACCGGUCA
GCUGCUGAAAAUUGCAAAACGUGGUGGUGUUACCGCAGUUGAAGCAGUUCAUGCAUGGCGUAAUGCACUGACCGGUGCACCGC
UGAAUCUGACACCGGAACAGGUUGUUGCAAUUGCCAGCCAUGAUGGUGGCAAACAGGCACUGGAAACCGUUCAGCGUCUGCUG
CCCGGUUCUGUGUCAGGCACAUGGUCUGACCCCUGAACAGGUGGUGGCAUUGCAAGCAAUAAUGGCGGUAAACAAGCCCUGGA
AACAGUGCAGCGCCUGUUACCGGUGCUGUGCCAGGCCCAUGGCUUAACUCCGGAACAGGUGGUAGCGAUCGCAUCAAACAAUG
GAGGUAAACAGGCCUUAGAAACCGUACAGCGCUUACUGCCGGUGUUAUGCCAGGCGCACGGCCUGACGCCAGAACAGGUAGUG
GCAAUCGCCUCACAUGACGGUGGAAAACAGGCGUUAGAGACAGUCCAGCGCCUGCUGCCUGUAUUAUGUCAAGCCCAUGGCCU
GACCCCAGAGCAAGUUGUUGCGAUUGCAAGUAAUAAUGGGGGUAAACAGGCACUUGAGACAGUUCAACGUUUACUGCCCUGUAC
UGUGCCAAGCUCACGGUCUGACUCCGGAACAAGUCGUCGCGAUUGCGAGUAAUGGUGGUGGCAAACAAGCAUUAGAAACGGUG
CAACGCCUGCUGCCAGUUCUUUGCCAGGCUCACGGUUUAACCCCUGAGCAGGUUGUAGCUAUUGCGAGUAACAAUGGUGGUAA
GCAGGCGUUGGAAACUGUGCAAAGACUGCUGCCCGUGUUGUGCCAAGCACAUGGUUUAACCCCAGAACAAGUCGUAGCAAUCG
CAAGCAAUAAUGGUGGCAAGCAAGCGCUUGAAACAGUACAGCGUUUAUUACCGGUACUUUGUCAGGCCCACGGUCUUACACCA
GAACAAGUUGUGGCCAUAGCCAGUAACAUUGGCGGAAAGCAGGCUCUGGAAACGGUACAACGUCUGUUACCUGUUCUGUGUCA
AGCGCACGGAUUAACACCUGAACAAGUAGUUGCCAUUGCGUCAAAUAAUGGAGGCAAGCAGGCCUUGGAGACAGUGCAGAGAU
UACUGCCAGUGUUGUGUCAGGCUCAUGGCCUUACACCCGAGCAGGUCGUGGCAAUUGCAUCUAACAAUGGCGGUAAGCAAGCU
UUAGAGACUGUUCAGAGACUGCUUCCUGUCCUGUGCCAGGCACACGGACUUACGCCUGAGCAAGUGGUUGCAAUCGCCUCUCA
UGAUGGUGGUAAGCAAGCACUGGAAACUGUCCAACGCUUACUUCCGGUGCUUUGUCAAGCACACGGCUUAACGCCAGAGCAGG
UCGUCGCCAUAGCCAGCAAUAGGUGGUAAACAGGCCCUUGAAACGGUCCAAAGACUUCUGCCGGUCCUUUGCCAAGCGCAU
GGGCUGACACCUGAGCAGGUAGUCGCGAUUGCCUCAAAUAAUGGUGGGAAGCAGGCAUUAGAAACAGUUCAAAGAUUAUUACC
AGUCCUGUGUCAGGCGCAUGGGUUAACCCCAGAGCAGGUAGUUGCAAUAGCAUCCAACAAUGGCGGAAAACAAGCGUUGGAAA
CGGUUCAGCGGUUAUUGCCUGUUUUGUGCCAGGCGCAUGGUUUGACACCCGAGCAAGUGGUAGCCAUAGCCUCAAAUAAUGGG
GGUAAACAAGCUUUGGAGACAGUACAACGGCUGCUUCCAGUUUUAUGUCAGGCCCAUGGAUUGACGCCUGAACAAGUUGUCGC
```

UAUCGCAAGUAAUAUCGGUGGUAAACAAGCGCUUGAAACCGUUCAACGCCUUCUGCCUGUGCUUUGUCAGGCACAUGGAUUAA

CACCCGAACAGGUUGUCGCGAUAGCUUCAAACAAUGGUGGUCGUCCGGCACUGGAAAGCAUUGUUGCACAGCUGAGCCGUCCU

GAUCCGGCACUGGCAGCACUGACCAAUGAUCAUCUGGUUGCACUGGCAUGUCUGGGGUGGUCGCCCUGCCCUGGAUGCAGUUAA

AAAAGGUCUGCCGCAUGCACCGGCACUGAUUAAACGUACCAAUCGUCGUAUUCCGGAACGUACCAGCCAUCGUGUUGCUAGC

>TAL2-VPR protein

SEQ ID NO.: 187

MAPKKKRKVGIHGVPAAGSSGSHMVDLRTLGYSQQQQEKIKPKVRSTVAQHHEALVGHGFTHAHIVALSQHPAALGTVAVKYQ

DMIAALPEATHEAIVGVGKRGAGARALEALLTVAGELRGPPLQLDTGQLLKIAKRGGVTAVEAVHAWRNALTGAPLULTPEQV

VAIASUGGGKQALETVQRLLPVLCQAHGLTPEQVVAIASUGGGKQALETVQRLLPVLCQAHGLTPEQVVAIASHDGGKQALET

VQRLLPVLCQAHGLTPEQVVAIASUNGGKQALETVQRLLPVLCQAHGLTPEQVVAIASUNGGKQALETVQRLLPVLCQAHGLT

PEQVVAIASUNGGKQALETVQRLLPVLCQAHGLTPEQVVAIASUNGGKQALETVQRLLPVLCQAHGLTPEQVVAIASNGGGKQ

ALETVQRLLPVLCQAHGLTPEQVVAIASUNGGKQALETVQRLLPVLCQAHGLTPEQVVAIASUNGGKQALETVQRLLPVLCQA

HGLTPEQVVAIASUNGGKQALETVQRLLPVLCQAHGLTPEQVVAIASHDGGKQALETVQRLLPVLCQAHGLTPEQVVAIASNN

GGKQALETVQRLLPVLCQAHGLTPEQVVAIASHDGGKQALETVQRLLPVLCQAHGLTPEQVVAIASHDGGKQALETVQRLLPV

LCQAHGLTPEQVVAIASHDGGKQALETVQRLLPVLCQAHGLTPEQVVAIASNIGGKQALETVQRLLPVLCQAHGLTPEQVVAI

ASUNGGRPALESIVAQLSRPDPALAALTNDHLVALACLGGRPALDAVKKGLPHAPALIKRTNRRIPERTSHRVASGSGGGSGG

DALDDFDLDMLGSDALDDFDLDMLGSDALDDFDLDMLGSDALDDFDLDMLSGGPKKKRKVGSQYLPDTDDRHRIEEKRKRTYE

TFKSIMKKSPFSGPTDPRPPPRRIAVPSRSSASVPKPAPQPYPFTSSLSTINYDEFPTMVFPSGQISQASALAPAPPQVLPQA

PAPAPAPAMVSALAQAPAPVPVLAPGPPQAVAPPAPKPTQAGEGTLSEALLQLQFDDEDLGALLGNSTDPAVFTDLASVDNSE

FQQLLNQGIPVAPHTTEPMLMEYPEAITRLVTGAQRPPDPAPAPLGAPGLPNGLLSGDEDFSSIADMDFSALLGSGSGSRDSR

EGMFLPKPEAGSAISDVFEGREVCQPKRLRPFHPPGSPWANRPLPASLAPTPTGPVHEPVGSLTPAPVPQPLDPAPAVTPEAS

HLLEDPDEETSQAVKALREMADTVIPQKEEAAICGQMDLSHPPPRGHLDELTTTLESMTEDLNLDSPLTPELNEILDTFLNDE

CLLHAMHISTGLSIFDTSLFSGGKRPAATKKAGQAKKKKGSYPYDVPDYA*

>TAL2-VPR mRNA

SEQ ID NO.: 188

AGGAAATAAGAGAGAAAAGAAGAGTAAGAAGAAATATAAGAGCCACCATGGCCCCCAAGAAGAAGCGGAAGGTGGGCATCCAC

GGCGTGCCCGCCGCCGGCAGCAGCGGATCCCATATGGTTGATCTGCGTACCCTGGGTTATAGCCAGCAGCAGCAAGAAAAAT

CAAACCGAAAGTTCGTAGCACCGTTGCACAGCATCATGAAGCACTGGTTGGTCATGGTTTTACCCATGCACATATTGTTGCAC

TGAGCCAGCATCCGGCAGCACTGGGCACCGTTGCAGTTAAATATCAGGATATGATTGCAGCACTGCCGGAAGCAACCCATGAA

GCAATTGTTGGTGTTGGTAAACGCGGAGCTGGTGCACGTGCCCTGGAAGCACTGCTGACCGTTGCCGGTGAACTGCGTGGTCC

GCCTCTGCAGCTGGATACCGGTCAGCTGCTGAAAATTGCAAAACGTGGTGGTGTTACCGCAGTTGAAGCAGTTCATGCATGGC

GTAATGCACTGACCGGTGCACCGCTGAATCTGACACCGGAACAGGTTGTTGCAATTGCCAGCAATGGTGGTGGCAAACAGGCA

CTGGAAACCGTTCAGCGTCTGCTGCCGGTTCTGTGTCAGGCACATGGTCTGACCCCTGAACAGGTGGTGGCCATTGCAAGCAA

TGGCGGCGGTAAACAAGCCCTGGAAACAGTGCAGCGCCTGTTACCGGTGCTGTGCCAGGCCCATGGCTTAACTCCGGAACAGG

TGGTAGCGATCGCATCACATGATGGAGGTAAACAGGCCTTAGAAACCGTACAGCGCTTACTGCCGGTGTTATGCCAGGCGCAC

GGCCTGACGCCAGAACAGGTAGTGGCAATCGCCTCAAATAATGGTGGAAAACAGGCGTTAGAGACAGTCCAGCGCCTGCTGCC

TGTATTATGTCAAGCCCATGGCCTGACCCCAGAGCAAGTTGTTGCGATTGCAAGTAACAATGGGGGTAAACAGGCACTTGAGA

CAGTTCAACGTTTACTGCCTGTACTGTGCCAAGCTCACGGTCTGACTCCGGAACAAGTCGTCGCGATTGCGAGTAATAATGGT

GGCAAACAAGCATTAGAAACGGTGCAACGCCTGCTGCCAGTTCTTTGCCAGGCTCACGGTTTAACCCCTGAGCAGGTTGTAGC

TATTGCGAGTAACAATGGTGGTAAGCAGGCGTTGGAAACTGTGCAAAGACTGCTGCCCGTGTTGTGCCAAGCACATGGTTTAA

CCCCAGAACAAGTCGTAGCAATCGCAAGCAATGGGGGTGGCAAGCAAGCGCTTGAAACAGTACAGCGTTTATTACCGGTACTT

TGTCAGGCCCACGGTCTTACACCAGAACAAGTTGTGGCCATAGCCAGTAATAATGGCGGAAAGCAGGCTCTGGAAACGGTACA

-continued

```
ACGTCTGTTACCTGTTCTGTGTCAAGCGCACGGATTAACACCTGAACAAGTAGTTGCCATTGCGTCAAACAATGGAGGCAAGC

AGGCCTTGGAGACAGTGCAGAGATTACTGCCAGTGTTGTGTCAGGCTCATGGCCTTACACCCGAGCAGGTCGTGGCAATTGCA

TCTAATAATGGCGGTAAGCAAGCTTTAGAGACTGTTCAGAGACTGCTTCCTGTCCTGTGCCAGGCACACGGACTTACGCCTGA

GCAAGTGGTTGCAATCGCCTCTCATGATGGTGGTAAGCAAGCACTGGAAACTGTCCAACGCTTACTTCCGGTGCTTTGTCAAG

CACACGGCTTAACGCCAGAGCAGGTCGTCGCCATAGCCAGCAACAATGGTGGTAAACAGGCCCTTGAAACGGTCCAAAGACTT

CTGCCGGTCCTTTGCCAAGCGCATGGGCTGACACCTGAGCAGGTAGTCGCGATTGCCTCACATGACGGTGGGAAGCAGGCATT

AGAAACAGTTCAAAGATTATTACCAGTCCTGTGTCAGGCGCATGGGTTAACCCCAGAGCAGGTAGTTGCAATAGCATCCCATG

ATGGCGGAAAACAAGCGTTGGAAACGGTTCAGCGGTTATTGCCTGTTTTGTGCCAGGCGCATGGTTTGACACCCGAGCAAGTG

GTAGCCATAGCCTCACATGACGGGGGTAAACAAGCTTTGGAGACAGTACAACGGCTGCTTCCAGTTTTATGTCAGGCCCATGG

ATTGACGCCTGAACAAGTTGTCGCTATCGCAAGTAACATTGGTGGTAAACAAGCGCTTGAAACCGTTCAACGCCTTCTGCCTG

TGCTTTGTCAGGCACATGGATTAACACCCGAACAGGTTGTCGCGATAGCTTCAAACAATGGTGGTCGTCGGCACTGGAAAGC

ATTGTTGCACAGCTGAGCCGTCCTGATCCGGCACTGGCAGCACTGACCAATGATCATCTGGTTGCACTGGCATGTCTGGGTGG

TCGCCCTGCCCTGGATGCAGTTAAAAAAGGTCTGCCGCATGCACCGGCACTGATTAAACGTACCAATCGTCGTATTCCGGAAC

GTACCAGCCATCGTGTTGCTAGCGGCAGCGGCGGCGCAGCGGCGGCGACGCCCTGGACGACTTCGACCTGGACATGCTGGGC

AGCGACGCCCTGGACGACTTCGACCTGGACATGCTGGGCAGCGACGCCCTGGACGACTTCGACCTGGACATGCTGGGCAGCGA

CGCCCTGGACGACTTCGACCTGGACATGCTGAGCGGCGGCCCCAAGAAGAAGCGGAAGGTGGGCAGCCAGTACCTGCCCGACA

CCGACGACCGGCACCGGATCGAGGAGAAGCGGAAGCGGACCTACGAGACCTTCAAGAGCATCATGAAGAAATCCCCCTTCAGC

GGCCCCACCGACCCCGGCCCCCCCCCCGGCGGATCGCCGTGCCCAGCCGGAGCAGCGCCAGCGTGCCCAAGCCCGCCCCCCA

GCCCTACCCCTTCACCAGCAGCCTGAGCACCATCAACTACGACGAGTTCCCCACCATGGTGTTCCCCAGCGGCCAGATCAGCC

AGGCCAGCGCCCTGGCCCCCGCCCCCCCCAGGTGCTGCCCCAGGCCCCGCCCCCGCCCCGCCCCGCCATGGTGAGCGCC

CTGGCCCAGGCCCCCGCCCCCGTGCCCGTGCTGGCCCCCGGCCCCCCCCAGGCCGTGGCCCCCCCGCCCCCAAGCCCACCCA

GGCCGGCGAGGGCACCCTGAGCGAGGCCCTGCTGCAGCTGCAGTTCGACGACGAGGACCTGGGCGCCCTGCTGGGCAACAGCA

CCGACCCCGCCGTGTTCACCGACCTGGCCAGCGTGGACAACAGCGAGTTCCAGCAGCTGCTGAACCAGGGCATCCCCGTGGCC

CCCCACACCACCGAGCCCATGCTGATGGAGTACCCCGAGGCCATCACCCGGCTGGTGACCGGCGCCCAGCGGCCCCCCGACCC

CGCCCCCGCCCCCCTGGGCGCCCCCGGCCTGCCCAACGGCCTGCTGAGCGGCGACGAGGACTTCAGCAGCATCGCCGACATGG

ACTTCAGCGCCCTGCTGGGCAGCGGCAGCGGCAGCCGGGACAGCCGGGAGGGCATGTTCCTGCCCAAGCCCGAGGCCGGCAGC

GCCATCAGCGACGTGTTCGAGGGCCGGGAGGTGTGCCAGCCCAAGCGGCTCCGGCCCTTCCACCCCCCGGCAGCCCCTGGGC

CAACCGGCCCCTGCCCGCCAGCCTGGCCCCCACCCCCACCGGCCCCGTGCACGAGCCCGTGGGCAGCCTGACCCCCGCCCCCG

TGCCCCAGCCCCTGGACCCCGCCCCCGCCGTGACCCCCGAGGCCAGCCACCTGCTGGAGGACCCCGACGAGGAGACCAGCCAG

GCCGTGAAGGCCCTGCGGGAGATGGCCGACACCGTGATCCCCCAGAAGGAGGAGGCCGCCATCTGCGGCCAGATGGACCTGAG

CCACCCCCCCCCCGGGGCCACCTGGACGAGCTGACCACCACCCTGGAGAGCATGACCGAGGACCTGAACCTGGACAGCCCCC

TGACCCCCGAGCTGAACGAGATCCTGGACACCTTCCTGAACGACGAGTGCCTGCTGCACGCCATGCACATCAGCACCGGCCTG

AGCATCTTCGACACCAGCCTGTTCAGCGGCGGCAAGCGGCCCGCCGCCACCAAGAAGGCCGGCCAGGCCAAGAAGAAGAAGGG

CAGCTACCCCTACGACGTGCCCGACTACGCCTGAGCGGCCGCTTAATTAAGCTGCCTTCTGCGGGGCTTGCCTTCTGGCCATG

CCCTTCTTCTCTCCCTTGCACCTGTACCTCTTGGTCTTTGAATAAAGCCTGAGTAGGAAGTCTAGAAAAAAAAAAAAAAAA

AAAAAAAAAAAAAAAAAAAAAAAAAAAAAAAAAAAAAAAAAAAAAAAAAAAAAA
```

>TAL2 amino acid sequence

SEQ ID NO.: 189

GSHMVDLRTLGYSQQQQEKIKPKVRSTVAQHHEALVGHGFTHAHIVALSQHPAALGTVAVKYQDMIAALPEATHEAIVGVGKR

GAGARALEALLTVAGELRGPPLQLDTGQLLKIAKRGGVTAVEAVHAWRNALTGAPLNLTPEQVVAIASNGGGKQALETVQRLL

PVLCQAHGLTPEQVVAIASNGGGKQALETVQRLLPVLCQAHGLTPEQVVAIASHDGGKQALETVQRLLPVLCQAHGLTPEQVV

AIASNNGGKQALETVQRLLPVLCQAHGLTPEQVVAIASNNGGKQALETVQRLLPVLCQAHGLTPEQVVAIASNNGGKQALETV

QRLLPVLCQAHGLTPEQVVAIASNNGGKQALETVQRLLPVLCQAHGLTPEQVVAIASNGGGKQALETVQRLLPVLCQAHGLTP
EQVVAIASUNGGKQALETVQRLLPVLCQAHGLTPEQVVAIASUNGGKQALETVQRLLPVLCQAHGLTPEQVVAIASNNGGKQA
LETVQRLLPVLCQAHGLTPEQVVAIASHDGGKQALETVQRLLPVLCQAHGLTPEQVVAIASUNGGKQALETVQRLLPVLCQAH
GLTPEQVVAIASHDGGKQALETVQRLLPVLCQAHGLTPEQVVAIASHDGGKQALETVQRLLPVLCQAHGLTPEQVVAIASHDG
GKQALETVQRLLPVLCQAHGLTPEQVVAIASNIGGKQALETVQRLLPVLCQAHGLTPEQVVAIASUNGGRPALESIVAQLSRP
DPALAALTNDHLVALACLGGRPALDAVKKGLPHAPALIKRTURRIPERTSHRVAS

>TAL2 mRNA sequence

SEQ ID NO.: 245

GGAUCCCAUAUGGUUGAUCUGCGUACCCUGGGUUAUAGCCAGCAGCAGCAAGAAAAAAUCAAACCGAAAGUUCGUAGCACCGU
UGCACAGCAUCAUGAAGCACUGGUUGGUCAUGGUUUUACCCAUGCACAUAUUGUUGCACUGAGCCAGCAUCCGGCAGCACUGG
GCACCGUUGCAGUUAAAUAUCAGGAUAUGAUUGCAGCACUGCCGGAAGCAACCCAUGAAGCAAUUGUUGUGUUGGUAAACGC
GGAGCUGGUGCACGUGCCCUGGAAGCACUGCUGACCGUUGCCGGUGAACUGCGUGGUCCGCCUCUGCAGCUGGAUACCGGUCA
GCUGCUGAAAAUUGCAAAACGUGGUGGUGUUACCGCAGUUGAAGCAGUUCAUGCAUGGCGUAAUGCACUGACCGGUGCACCGC
UGAAUCUGACACCGGAACAGGUUGUUGCAAUUGCCAGCAAUGGUGGUGGCAAACAGGCACUGGAAACCGUUCAGCGUCUGCUG
CCGGUUCUGUGUCAGGCACAUGGCUGACCCCUGAACAGGUGGUGGCCAUUGCAAGCAAUGGCGGCGGUAAACAAGCCCUGGA
AACAGUGCAGCGCCUGUUACCGGUGCUGUGCCAGGCCCAUGGCUUAACUCCGGAACAGGUGGUAGCGAUCGCAUCACAUGAUG
GAGGUAAACAGGCCUUAGAAACCGUACAGCGCUUACUGCCGGUGUUAUGCCAGGCGCACGGCCUGACGCCAGAACAGGUAGUG
GCAAUCGCCUCAAAUAAUGGUGGAAAACAGGCGUUAGAGACAGUCCAGCGCCUGCUGCCUGUAUUAUGUCAAGCCCAUGGCCU
GACCCCAGAGCAAGUUGUUGCGAUUGCAAGUAACAAUGGGGGUAAACAGGCACUUGAGACAGUUCAACGUUUACUGCCUGUAC
UGUGCCAAGCUCACGGUCUGACUCCGGAACAAGUCGUCGCGAUUGCGAGUAAUAAUGGUGGCAAACAAGCAUUAGAAACGGUG
CAACGCCUGCUGCCAGUUCUUUGCCAGGCUCACGGUUUUAACCCCUGAGCAGGUUGUAGCUAUUGCGAGUAACAAUGGUGGUAA
GCAGGCGUUGGAAACUGUGCAAAGACUGCUGCCCGUGUUGUGCCAAGCACAUGGUUUAACCCCAGAACAAGUCGUAGCAAUCG
CAAGCAAUGGGGGUGGCAAGCAAGCGCUUGAAACAGUACAGCGUUUAUUACCGGUACUUUGUCAGGCCCACGGUCUUACACCA
GAACAAGUUGUGGCCAUAGCCAGUAAUAAUGGCGGAAAGCAGGCUCUGGAAACGGUACAACGUCUGUUACCUGUUCUGUGUCA
AGCGCACGGAUUAACACCUGAACAAGUAGUUGCCAUUGCGUCAAACAAUGGAGGCAAGCAGGCCUUGGAGACAGUGCAGAGAU
UACUGCCAGUGUUGUGUCAGGCUCAUGGCCUUACACCCGAGCAGGUCGUGGCAAUUGCAUCUAAUAAUGGCGGUAAGCAAGCU
UUAGAGACUGUUCAGAGACUGCUUCCUGUCCUGUGCCAGGCACACGGACUUACGCCUGAGCAAGUGGUUGCAAUCGCCUCUCA
UGAUGGUGGUAAGCAAGCACUGGAAACUGUCCAACGCUUACUUCCGGUGCUUUGUCAAGCACACGGCUUAACGCCAGAGCAGG
UCGUCGCCAUAGCCAGCAACAAUGGUGGUAAACAGGCCCUUGAAACGGUCCAAAGACUUCUGCCGGUCCUUUGCCAAGCGCAU
GGGCUGACACCUGAGCAGGUAGUCGCGAUUGCCUCACAUGACGGUGGGAAGCAGGCAUUAGAAACAGUUCAAAGAUUAUUACC
AGUCCUGUGUCAGGCGCAUGGGUUAACCCCAGAGCAGGUAGUUGCAAUAGCAUCCCAUGAUGGCGGAAAACAAGCGUUGGAAA
CGGUUCAGCGGUUAUUGCCUGUUUUGUGCCAGGCGCAUGGUUUGACACCCGAGCAAGUGGUAGCCAUAGCCUCACAUGACGGG
GGUAAACAAGCUUUGGAGACAGUACAACGGCUGCUUCCAGUUUUAUGUCAGGCCCAUGGAUUGACGCCUGAACAAGUUGUCGC
UAUCGCAAGUAACAUUGGUGGUAAACAAGCGCUUGAAACCGUUCAACGCCUUCUGCCUGUGCUUUGUCAGGCACAUGGAUUAA
CACCCGAACAGGUUGUCGCGAUAGCUUCAAACAAUGGUGGUCGUCCGGCACUGGAAAGCAUUGUUGCACAGCUGAGCCGUCCU
GAUCCGGCACUGGCAGCACUGACCAAUGAUCAUCUGGUUGCACUGGCAUGUCUGGGUGGUCGCCCUGCCCUGGAUGCAGUUAA
AAAAGGUCUGCCGCAUGCACCGGCACUGAUUAAACGUACCAAUCGUCGUAUUCCGGAACGUACCAGCCAUCGUGUUGCUAGC

>TAL3-VPR protein

SEQ ID NO.: 190

MAPKKKRKVGIHGVPAAGSSGSHMVDLRTLGYSQQQQEKIKPKVRSTVAQHHEALVGHGFTHAHIVALSQHPAALGTVAVKYQ
DMIAALPEATHEAIVGVGKRGAGARALEALLTVAGELRGPPLQLDTGQLLKIAKRGGVTAVEAVHAWRNALTGAPLULTPEQV
VAIASUNGGKQALETVQRLLPVLCQAHGLTPEQVVAIASUGGGKQALETVQRLLPVLCQAHGLTPEQVVAIASNGGGKQALET

-continued

VQRLLPVLCQAHGLTPEQVVAIASUGGGKQALETVQRLLPVLCQAHGLTPEQVVAIASUNGGKQALETVQRLLPVLCQAHGLT

PEQVVAIASNIGGKQALETVQRLLPVLCQAHGLTPEQVVAIASNIGGKQALETVQRLLPVLCQAHGLTPEQVVAIASNIGGKQ

ALETVQRLLPVLCQAHGLTPEQVVAIASUNGGKQALETVQRLLPVLCQAHGLTPEQVVAIASUNGGKQALETVQRLLPVLCQA

HGLTPEQVVAIASNIGGKQALETVQRLLPVLCQAHGLTPEQVVAIASNIGGKQALETVQRLLPVLCQAHGLTPEQVVAIASNN

GGKQALETVQRLLPVLCQAHGLTPEQVVAIASUNGGKQALETVQRLLPVLCQAHGLTPEQVVAIASHDGGKQALETVQRLLPV

LCQAHGLTPEQVVAIASNIGGKQALETVQRLLPVLCQAHGLTPEQVVAIASUNGGKQALETVQRLLPVLCQAHGLTPEQVVAI

ASNIGGRPALESIVAQLSRPDPALAALTNDHLVALACLGGRPALDAVKKGLPHAPALIKRTURRIPERTSHRVASGSGGGSGG

DALDDFDLDMLGSDALDDFDLDMLGSDALDDFDLDMLGSDALDDFDLDMLSGGPKKKRKVGSQYLPDTDDRHRIEEKRKRTYE

TFKSIMKKSPFSGPTDPRPPPRRIAVPSRSSASVPKPAPQPYPFTSSLSTINYDEFPTMVFPSGQISQASALAPAPPQVLPQA

PAPAPAPAMVSALAQAPAPVPVLAPGPPQAVAPPAPKPTQAGEGTLSEALLQLQFDDEDLGALLGNSTDPAVFTDLASVDNSE

FQQLLNQGIPVAPHTTEPMLMEYPEAITRLVTGAQRPPDPAPAPLGAPGLPNGLLSGDEDFSSIADMDFSALLGSGSGSRDSR

EGMFLPKPEAGSAISDVFEGREVCQPKRLRPFHPPGSPWANRPLPASLAPTPTGPVHEPVGSLTPAPVPQPLDPAPAVTPEAS

HLLEDPDEETSQAVKALREMADTVIPQKEEAAICGQMDLSHPPPRGHLDELTTTLESMTEDLNLDSPLTPELNEILDTFLNDE

CLLHAMHISTGLSIFDTSLFSGGKRPAATKKAGQAKKKKGSYPYDVPDYA

>TAL3-VPR mRNA

SEQ ID NO.: 191

AGGAAATAAGAGAGAAAAGAAGAGTAAGAAGAAATATAAGAGCCACCATGGCCCCCAAGAAGAAGCGGAAGGTGGGCATCCAC

GGCGTGCCCGCCGCCGGCAGCAGCGGATCCCATATGGTTGATCTGCGTACCCTGGGTTATAGCCAGCAGCAGCAAGAAAAAAT

CAAACCGAAAGTTCGTAGCACCGTTGCACAGCATCATGAAGCACTGGTTGGTCATGGTTTTACCCATGCACATATTGTTGCAC

TGAGCCAGCATCCGGCAGCACTGGGCACCGTTGCAGTTAAATATCAGGATATGATTGCAGCACTGCCGGAAGCAACCCATGAA

GCAATTGTTGGTGTTGGTAAACGCGGAGCTGGTGCACGTGCCCTGGAAGCACTGCTGACCGTTGCCGGTGAACTGCGTGGTCC

GCCTCTGCAGCTGGATACCGGTCAGCTGCTGAAAATTGCAAAACGTGGTGGTGTTACCGCAGTTGAAGCAGTTCATGCATGGC

GTAATGCACTGACCGGTGCACCGCTGAATCTGACACCGGAACAGGTTGTTGCAATTGCCAGCAATAATGGTGGCAAACAGGCA

CTGGAAACCGTTCAGCGTCTGCTGCCGGTTCTGTGTCAGGCACATGGTCTGACCCCTGAACAGGTGGTGGCCATTGCAAGCAA

TGGTGGCGGTAAACAAGCCCTGGAAACAGTGCAGCGCCTGTTACCGGTGCTGTGCCAGGCCCATGGCTTAACTCCGGAACAGG

TGGTAGCGATCGCATCAAATGGCGGAGGTAAACAGGCCTTAGAAACCGTACAGCGCTTACTGCCGGTGTTATGCCAGGCGCAC

GGCCTGACGCCAGAACAGGTAGTGGCAATCGCCTCAAATGGGGGTGGAAAACAGGCGTTAGAGACAGTCCAGCGCCTGCTGCC

TGTATTATGTCAAGCCCATGGCCTGACCCCAGAGCAAGTTGTTGCGATTGCAAGTAACAATGGGGGTAAACAGGCACTTGAGA

CAGTTCAACGTTTACTGCCTGTACTGTGCCAAGCTCACGGTCTGACTCCGGAACAAGTCGTCGCGATTGCGAGTAACATTGGT

GGCAAACAAGCATTAGAAACGGTGCAACGCCTGCTGCCAGTTCTTTGCCAGGCTCACGGTTTAACCCCTGAGCAGGTTGTAGC

TATTGCGAGTAATATCGGTGGTAAGCAGGCGTTGGAAACTGTGCAAAGACTGCTGCCCGTGTTGTGCCAAGCACATGGTTTAA

CCCCAGAACAAGTCGTAGCAATCGCAAGCAATATAGGTGGCAAGCAAGCGCTTGAAACAGTACAGCGTTTATTACCGGTACTT

TGTCAGGCCCACGGTCTTACACCAGAACAAGTTGTGGCCATAGCCAGTAATAATGGCGGAAAGCAGGCTCTGGAAACGGTACA

ACGTCTGTTACCTGTTCTGTGTCAAGCGCACGGATTAACACCTGAACAAGTAGTTGCCATTGCGTCAAACAATGGAGGCAAGC

AGGCCTTGGAGACAGTGCAGAGATTACTGCCAGTGTTGTGTCAGGCTCATGGCCTTACACCCGAGCAGGTCGTGGCAATTGCA

TCTAACATTGGCGGTAAGCAAGCTTTAGAGACTGTTCAGAGACTGCTTCCTGTCCTGTGCCAGGCACACGGACTTACGCCTGA

GCAAGTGGTTGCAATCGCCTCTAATATCGGTGGTAAGCAAGCACTGGAAACTGTCCAACGCTTACTTCCGGTGCTTTGTCAAG

CACACGGCTTAACGCCAGAGCAGGTCGTCGCCATAGCCAGCAATAATGGTGGTAAACAGGCCCTTGAAACGGTCCAAAGACTT

CTGCCGGTCCTTTGCCAAGCGCATGGGCTGACACCTGAGCAGGTAGTCGCGATTGCCTCAAACAATGGTGGGAAGCAGGCATT

AGAAACAGTTCAAAGATTATTACCAGTCCTGTGTCAGGCGCATGGGTTAACCCCAGAGCAGGTAGTTGCAATAGCATCCCATG

ATGGCGGAAAACAAGCGTTGGAAACGGTTCAGCGGTTATTGCCTGTTTTGTGCCAGGCGCATGGTTTGACACCCGAGCAAGTG

GTAGCCATAGCCCTCAAATATAGGGGGTAAACAAGCTTTGGAGACAGTACAACGGCTGCTTCCAGTTTTATGTCAGGCCCATGG

-continued

```
ATTGACGCCTGAACAAGTTGTCGCTATCGCAAGTAATAATGGTGGTAAACAAGCGCTTGAAACCGTTCAACGCCTTCTGCCTG

TGCTTTGTCAGGCACATGGATTAACACCCGAACAGGTTGTCGCGATAGCTTCAAACATTGGTGGTCGTCCGGCACTGGAAAGC

ATTGTTGCACAGCTGAGCCGTCCTGATCCGGCACTGGCAGCACTGACCAATGATCATCTGGTTGCACTGGCATGTCTGGGTGG

TCGCCCTGCCCTGGATGCAGTTAAAAAAGGTCTGCCGCATGCACCGGCACTGATTAAACGTACCAATCGTCGTATTCCGGAAC

GTACCAGCCATCGTGTTGCTAGCGGCAGCGGCGGCGGCAGCGGCGGCGACGCCCTGGACGACTTCGACCTGGACATGCTGGGC

AGCGACGCCCTGGACGACTTCGACCTGGACATGCTGGGCAGCGACGCCCTGGACGACTTCGACCTGGACATGCTGGGCAGCGA

CGCCCTGGACGACTTCGACCTGGACATGCTGAGCGGCGGCCCCAAGAAGAAGCGGAAGGTGGGCAGCCAGTACCTGCCCGACA

CCGACGACCGGCACCGGATCGAGGAGAAGCGGAAGCGGACCTACGAGACCTTCAAGAGCATCATGAAGAAATCCCCCTTCAGC

GGCCCCACCGACCCCCGGCCCCCCCCCGGCGGATCGCCGTGCCCAGCCGGAGCAGCGCCAGCGTGCCCAAGCCCGCCCCCCA

GCCCTACCCCTTCACCAGCAGCCTGAGCACCATCAACTACGACGAGTTCCCCACCATGGTGTTCCCCAGCGGCCAGATCAGCC

AGGCCAGCGCCCTGGCCCCCGCCCCCCCCCAGGTGCTGCCCCAGGCCCCCGCCCCCGCCCCCGCCCCCGCCATGGTGAGCGCC

CTGGCCCAGGCCCCCGCCCCCGTGCCCGTGCTGGCCCCCGGCCCCCCCCAGGCCGTGGCCCCCCCCGCCCCCAAGCCCACCCA

GGCCGGCGAGGGCACCCTGAGCGAGGCCCTGCTGCAGCTGCAGTTCGACGACGAGGACCTGGGCGCCCTGCTGGGCAACAGCA

CCGACCCCGCCGTGTTCACCGACCTGGCCAGCGTGGACAACAGCGAGTTCCAGCAGCTGCTGAACCAGGGCATCCCCGTGGCC

CCCCACACCACCGAGCCCATGCTGATGGAGTACCCCGAGGCCATCACCCGGCTGGTGACCGGCGCCCAGCGGCCCCCCGACCC

CGCCCCCGCCCCCTGGGCGCCCCCGGCCTGCCCAACGGCCTGCTGAGCGGCGACGAGGACTTCAGCAGCATCGCCGACATGG

ACTTCAGCGCCCTGCTGGGCAGCGGCAGCGGCAGCCGGGACAGCCGGGAGGGCATGTTCCTGCCCAAGCCCGAGGCCGGCAGC

GCCATCAGCGACGTGTTCGAGGGCCGGGAGGTGTGCCAGCCCAAGCGGCTCCGGCCCTTCCACCCCCCCGGCAGCCCCTGGGC

CAACCGGCCCCTGCCCGCCAGCCTGGCCCCCACCCCCACCGGCCCCGTGCACGAGCCCGTGGGCAGCCTGACCCCCGCCCCCG

TGCCCCAGCCCCTGGACCCCGCCCCCGCCGTGACCCCCGAGGCCAGCCACCTGCTGGAGGACCCCGACGAGGAGACCAGCCAG

GCCGTGAAGGCCCTGCGGGAGATGGCCGACACCGTGATCCCCCAGAAGGAGGAGGCCGCCATCTGCGGCCAGATGGACCTGAG

CCACCCCCCCCCCGGGGCCACCTGGACGAGCTGACCACCACCCTGGAGAGCATGACCGAGGACCTGAACCTGGACAGCCCCC

TGACCCCCGAGCTGAACGAGATCCTGGACACCTTCCTGAACGACGAGTGCCTGCTGCACGCCATGCACATCAGCACCGGCCTG

AGCATCTTCGACACCAGCCTGTTCAGCGGCGGCAAGCGGCCCGCCGCCACCAAGAAGGCCGGCCAGGCCAAGAAGAAGAAGGG

CAGCTACCCCTACGACGTGCCCGACTACGCCTGAGCGGCCGCTTAATTAAGCTGCCTTCTGCGGGGCTTGCCTTCTGGCCATG

CCCTTCTTCTCTCCCTTGCACCTGTACCTCTTGGTCTTTGAATAAAGCCTGAGTAGGAAGTCTAGAAAAAAAAAAAAAAAAAA

AAAAAAAAAAAAAAAAAAAAAAAAAAAAAAAAAAAAAAAAAAAAAAAAAAAAAAAAA
```

>TAL3 amino acid sequence

SEQ ID NO.: 192

GSHMVDLRTLGYSQQQQEKIKPKVRSTVAQHHEALVGHGFTHAHIVALSQHPAALGTVAVKYQDMIAALPEATHEAIVGVGKR

GAGARALEALLTVAGELRGPPLQLDTGQLLKIAKRGGVTAVEAVHAWRNALTGAPLULTPEQVVAIASUNGGKQALETVQRLL

PVLCQAHGLTPEQVVAIASUGGGKQALETVQRLLPVLCQAHGLTPEQVVAIASUGGGKQALETVQRLLPVLCQAHGLTPEQVV

AIASUGGGKQALETVQRLLPVLCQAHGLTPEQVVAIASUNGGKQALETVQRLLPVLCQAHGLTPEQVVAIASNIGGKQALETV

QRLLPVLCQAHGLTPEQVVAIASNIGGKQALETVQRLLPVLCQAHGLTPEQVVAIASNIGGKQALETVQRLLPVLCQAHGLTP

EQVVAIASUNGGKQALETVQRLLPVLCQAHGLTPEQVVAIASUNGGKQALETVQRLLPVLCQAHGLTPEQVVAIASNIGGKQA

LETVQRLLPVLCQAHGLTPEQVVAIASNIGGKQALETVQRLLPVLCQAHGLTPEQVVAIASUNGGKQALETVQRLLPVLCQAH

GLTPEQVVAIASUNGGKQALETVQRLLPVLCQAHGLTPEQVVAIASHDGGKQALETVQRLLPVLCQAHGLTPEQVVAIASNIG

GKQALETVQRLLPVLCQAHGLTPEQVVAIASUNGGKQALETVQRLLPVLCQAHGLTPEQVVAIASNIGGRPALESIVAQLSRP

DPALAALTNDHLVALACLGGRPALDAVKKGLPHAPALIKRTURRIPERTSHRVAS

-continued

>TAL3 mRNA sequence
SEQ ID NO.: 246
GGAUCCCAUAUGGUUGAUCUGCGUACCCUGGGUUAUAGCCAGCAGCAGCAAGAAAAAAUCAAACCGAAAGUUCGUAGCACCGU UGCACAGCAUCAUGAAGCACUGGUUGGUCAUGGUUUUACCCAUGCACAUAUUGUUGCACUGAGCCAGCAUCCGGCAGCACUGG GCACCGUUGCAGUUAAAUAUCAGGAUAUGAUUGCAGCACUGCCGGAAGCAACCCAUGAAGCAAUUGUUGGUGUUGGUAAACGC GGAGCUGGUGCACGUGCCCUGGAAGCACUGCUGACCGUUGCCGGUGAACUGCGUGGUCCGCCUCUGCAGCUGGAUACCGGUCA GCUGCUGAAAAUUGCAAAACGUGGUGGUGUUACCGCAGUUGAAGCAGUUCAUGCAUGGCGUAAUGCACUGACCGGUGCACCGC UGAAUCUGACACCGGAACAGGUUGUUGCAAUUGCCAGCAAUAAUGGUGGCAAACAGGCACUGGAAACCGUUCAGCGUCUGCUG CCGGUUCUGUGUCAGGCACAUGGUCUGACCCCUGAACAGGUGGUGGCCAUUGCAAGCAAUGGUGGCGGUAAACAAGCCCUGGA AACAGUGCAGCGCCUGUUACCGGUGCUGUGCCAGGCCCAUGGCUUAACUCCGGAACAGGUGGUAGCGAUCGCAUCAAAUGGCG GAGGUAAACAGGCCUUAGAAACCGUACAGCGCUUACUGCCGGUGUUAUGCCAGGCGCACGGCCUGACGCCAGAACAGGUAGUG GCAAUCGCCUCAAAUGGGGGUGGAAAACAGGCGUUAGAGACAGUCCAGCGCCUGCUGCCUGUAUUAUGUCAAGCCCAUGGCCU GACCCCAGAGCAAGUUGUUGCGAUUGCAAGUAACAAUGGGGGUAAACAGGCACUUGAGACAGUUCAACGUUUACUGCCUGUAC UGUGCCAAGCUCACGGUCUGACUCCGGAACAAGUCGUCGCGAUUGCGAGUAACAUUGGUGGCAAACAAGCAUUAGAAACGGUG CAACGCCUGCUGCCAGUUCUUUGCCAGGCUCACGGUUUAACCCCUGAGCAGGUUGUAGCUAUUGCGAGUAAUAUCGGUGGUAA GCAGGCGUUGGAAACUGUGCAAAGACUGCUGCCCGUGUUGUGCCAAGCACAUGGUUUAACCCCAGAACAAGUCGUAGCAAUCG CAAGCAAUAUAGGUGGCAAGCAAGCGCUUGAAACAGUACAGCGUUUAUUACCGGUACUUUGUCAGGCCCACGGUCUUACACCA GAACAAGUUGUGGCCAUAGCCAGUAAUAAUGGCGGAAAGCAGGCUCUGGAAACGGUACAACGUCUGUUACCUGUUCUGUGUCA AGCGCACGGAUUAACACCUGAACAAGUAGUUGCCAUUGCGUCAAACAAUGGAGGCAAGCAGGCCUUGGAGACAGUGCAGAGAU UACUGCCAGUGUUGUGUCAGGCUCAUGGCCUUACACCCGAGCAGGUCGUGGCAAUUGCAUCUAACAUUGGCGGUAAGCAAGCU UUAGAGACUGUUCAGAGACUGCUUCCUGUCCUGUGCCAGGCACACGGACUUACGCCUGAGCAAGUGGUUGCAAUCGCCUCUAA UAUCGGUGGUAAGCAAGCACUGGAAACUGUCCAACGCUUACUUCCGGUGCUUUGUCAAGCACACGGCUUAACGCCAGAGCAGG UCGUCGCCAUAGCCAGCAAUAAUGGUGGUAAACAGGCCCUUGAAACGGUCCAAAGACUUCUGCCGGUCCUUUGCCAAGCGCAU GGGCUGACACCUGAGCAGGUAGUCGCGAUUGCCUCAAACAAUGGUGGAAGCAGGCAUUAGAAACAGUUCAAAGAUUAUUACC AGUCCUGUGUCAGGCGCAUGGGUUAACCCCAGAGCAGGUAGUUGCAAUAGCAUCCCAUGAUGGCGGAAAACAAGCGUUGGAAA CGGUUCAGCGGUUAUUGCCUGUUUUGUGCCAGGCGCAUGGUUUGACACCCGAGCAAGUGGUAGCCAUAGCCUCAAAUAUAGGG GGUAAACAAGCUUUGGAGACAGUACAACGGCUGCUUCCAGUUUUAUGUCAGGCCCAUGGAUUGACGCCUGAACAAGUUGUCGC UAUCGCAAGUAAUAAUGGUGGUAAACAAGCGCUUGAAACCGUUCAACGCCUUCUGCCUGUGCUUUGUCAGGCACAUGGAUUAA CACCCGAACAGGUUGUCGCGAUAGCUUCAAACAUUGGUGGUCGUCCGGCACUGGAAAGCAUUGUUGCACAGCUGAGCCGUCCU GAUCCGGCACUGGCAGCACUGACCAAUGAUCAUCUGGUUGCACUGGCAUGUCUGGGUGGUCGCCCUGCCCUGGAUGCAGUUAA AAAAGGUCUGCCGCAUGCACCGGCACUGAUUAAACGUACCAAUCGUCGUAUUCCGGAACGUACCAGCCAUCGUGUUGCUAGC >TAL4-VPR protein
SEQ ID NO.: 193
MAPKKKRKVGIHGVPAAGSSGSHMVDLRTLGYSQQQQEKIKPKVRSTVAQHHEALVGHGFTHAHIVALSQHPAALGTVAVKYQ DMIAALPEATHEAIVGVGKRGAGARALEALLTVAGELRGPPLQLDTGQLLKIAKRGGVTAVEAVHAWRNALTGAPLNLTPEQV VAIASHDGGKQALETVQRLLPVLCQAHGLTPEQVVAIASHDGGKQALETVQRLLPVLCQAHGLTPEQVVAIASNIGGKQALET VQRLLPVLCQAHGLTPEQVVAIASNNGGKQALETVQRLLPVLCQAHGLTPEQVVAIASHDGGKQALETVQRLLPVLCQAHGLT PEQVVAIASNIGGKQALETVQRLLPVLCQAHGLTPEQVVAIASNNGGKQALETVQRLLPVLCQAHGLTPEQVVAIASNIGGKQ ALETVQRLLPVLCQAHGLTPEQVVAIASNGGGKQALETVQRLLPVLCQAHGLTPEQVVAIASHDGGKQALETVQRLLPVLCQA HGLTPEQVVAIASNGGGKQALETVQRLLPVLCQAHGLTPEQVVAIASNGGGKQALETVQRLLPVLCQAHGLTPEQVVAIASHD GGKQALETVQRLLPVLCQAHGLTPEQVVAIASHDGGKQALETVQRLLPVLCQAHGLTPEQVVAIASHDGGKQALETVQRLLPV LCQAHGLTPEQVVAIASNIGGKQALETVQRLLPVLCQAHGLTPEQVVAIASNNGGKQALETVQRLLPVLCQAHGLTPEQVVAI -continued ASNIGGRPALESIVAQLSRPDPDALAALTNDHLVALACLGGRPALDAVKKGLPHAPALIKRTNRRIPERTSHRVASGSGGGSGG DALDDFDLDMLGSDALDDFDLDMLGSDALDDFDLDMLGSDALDDFDLDMLSGGPKKKRKVGSQYLPDTDDRHRIEEKRKRTYE TFKSIMKKSPFSGPTDPRPPPRRIAVPSRSSASVPKPAPQPYPFTSSLSTINYDEFPTMVFPSGQISQASALAPAPPQVLPQA PAPAPAPAMVSALAQAPAPVPVLAPGPPQAVAPPAPKPTQAGEGTLSEALLQLQFDDEDLGALLGNSTDPAVFTDLASVDNSE FQQLLNQGIPVAPHTTEPMLMEYPEAITRLVTGAQRPPDPAPAPLGAPGLPNGLLSGDEDFSSIADMDFSALLGSGSGSRDSR EGMFLPKPEAGSAISDVFEGREVCQPKRLRPFHPPGSPWANRPLPASLAPTPTGPVHEPVGSLTPAPVPQPLDPAPAVTPEAS HLLEDPDEETSQAVKALREMADTVIPQKEEAAICGQMDLSHPPPRGHLDELTTTLESMTEDLNLDSPLTPELNEILDTFLNDE

CLLHAMHISTGLSIFDTSLFSGGKRPAATKKAGQAKKKKGSYPYDVPDY*

>TAL4-VPR mRNA

SEQ ID NO.: 194

AGGAAATAAGAGAGAAAAGAAGAGTAAGAAGAAATATAAGAGCCACCATGGCCCCCAAGAAGAAGCGGAAGGTGGGCATCCAC

GGCGTGCCCGCCGCCGGCAGCAGCGGATCCCATATGGTTGATCTGCGTACCCTGGGTTATAGCCAGCAGCAGCAAGAAAAAAT

CAAACCGAAAGTTCGTAGCACCGTTGCACAGCATCATGAAGCACTGGTTGGTCATGGTTTTACCCATGCACATATTGTTGCAC

TGAGCCAGCATCCGGCAGCACTGGGCACCGTTGCAGTTAAATATCAGGATATGATTGCAGCACTGCCGGAAGCAACCCATGAA

GCAATTGTTGGTGTTGGTAAACGCGGAGCTGGTGCACGTGCCCTGGAAGCACTGCTGACCGTTGCCGGTGAACTGCGTGGTCC

GCCTCTGCAGCTGGATACCGGTCAGCTGCTGAAAATTGCAAAACGTGGTGGTGTTACCGCAGTTGAAGCAGTTCATGCATGGC

GTAATGCACTGACCGGTGCACCGCTGAATCTGACACCGGAACAGGTTGTTGCAATTGCCAGCCATGATGGTGGCAAACAGGCA

CTGGAAACCGTTCAGCGTCTGCTGCCGGTTCTGTGTCAGGCACATGGTCTGACCCCTGAACAGGTGGTGGCCATTGCAAGCCA

TGACGGCGGTAAACAAGCCCTGGAAACAGTGCAGCGCCTGTTACCGGTGCTGTGCCAGGCCCATGGCTTAACTCCGGAACAGG

TGGTAGCGATCGCATCAAACATTGGAGGTAAACAGGCCTTAGAAACCGTACAGCGCTTACTGCCGGTGTTATGCCAGGCGCAC

GGCCTGACGCCAGAACAGGTAGTGGCAATCGCCTCAAATAATGGTGGAAAACAGGCGTTAGAGACAGTCCAGCGCCTGCTGCC

TGTATTATGTCAAGCCCATGGCCTGACCCCAGAGCAAGTTGTTGCGATTGCAAGTCATGATGGGGGTAAACAGGCACTTGAGA

CAGTTCAACGTTTACTGCCTGTACTGTGCCAAGCTCACGGTCTGACTCCGGAACAAGTCGTCGCGATTGCGAGTAATATCGGT

GGCAAACAAGCATTAGAAACGGTGCAACGCCTGCTGCCAGTTCTTTGCCAGGCTCACGGTTTAACCCCTGAGCAGGTTGTAGC

TATTGCGAGTAACAATGGTGGTAAGCAGGCGTTGGAAACTGTGCAAAGACTGCTGCCCGTGTTGTGCCAAGCACATGGTTTAA

CCCCAGAACAAGTCGTAGCAATCGCAAGCAATATAGGTGGCAAGCAAGCGCTTGAAACAGTACAGCGTTTATTACCGGTACTT

TGTCAGGCCCACGGTCTTACACCAGAACAAGTTGTGGCCATAGCCAGTAATGGTGGCGGAAAGCAGGCTCTGGAAACGGTACA

ACGTCTGTTACCTGTTCTGTGTCAAGCGCACGGATTAACACCTGAACAAGTAGTTGCCATTGCGTCACATGACGGAGGCAAGC

AGGCCTTGGAGACAGTGCAGAGATTACTGCCAGTGTTGTGTCAGGCTCATGGCCTTACACCCGAGCAGGTCGTGGCAATTGCA

TCTAATGGCGGCGGTAAGCAAGCTTTAGAGACTGTTCAGAGACTGCTTCCTGTCCTGTGCCAGGCACACGGACTTACGCCTGA

GCAAGTGGTTGCAATCGCCTCTAATGGGGGTGGTAAGCAAGCACTGGAAACTGTCCAACGCTTACTTCCGGTGCTTTGTCAAG

CACACGGCTTAACGCCAGAGCAGGTCGTCGCCATAGCCAGCCATGATGGTGGTAAACAGGCCCTTGAAACGGTCCAAAGACTT

CTGCCGGTCCTTTGCCAAGCGCATGGGCTGACACCTGAGCAGGTAGTCGCGATTGCCTCACATGACGGTGGGAAGCAGGCATT

AGAAACAGTTCAAAGATTATTACCAGTCCTGTGTCAGGCGCATGGGTTAACCCCAGAGCAGGTAGTTGCAATAGCATCCCATG

ATGGCGGAAAACAAGCGTTGGAAACGGTTCAGCGGTTATTGCCTGTTTTGTGCCAGGCGCATGGTTTGACACCCGAGCAAGTG

GTAGCCATAGCCTCAAACATTGGGGGTAAACAAGCTTTGGAGACAGTACAACGGCTGCTTCCAGTTTTATGTCAGGCCCATGG

ATTGACGCCTGAACAAGTTGTCGCTATCGCAAGTAATAATGGTGGTAAACAAGCGCTTGAAACCGTTCAACGCCTTCTGCCTG

TGCTTTGTCAGGCACATGGATTAACACCCGAACAGGTTGTCGCGATAGCTTCAAATATCGGTGGTCGTCCGGCACTGGAAAGC

ATTGTTGCACAGCTGAGCCGTCCTGATCCGGCACTGGCAGCACTGACCAATGATCATCTGGTTGCACTGGCATGTCTGGGTGG

TCGCCCTGCCCTGGATGCAGTTAAAAAAGGTCTGCCGCATGCACCGGCACTGATTAAACGTACCAATCGTCGTATTCCGGAAC

GTACCAGCCATCGTGTTGCTAGCGGCAGCGGCGGCGGCAGCGGCGGCGACGCCCTGGACGACTTCGACCTGGACATGCTGGGC

AGCGACGCCCTGGACGACTTCGACCTGGACATGCTGGGCAGCGACGCCCTGGACGACTTCGACCTGGACATGCTGGGCAGCGA

-continued

```
CGCCCTGGACGACTTCGACCTGGACATGCTGAGCGGCGGCCCCAAGAAGAAGCGGAAGGTGGGCAGCCAGTACCTGCCCGACA

CCGACGACCGGCACCGGATCGAGGAGAAGCGGAAGCGGACCTACGAGACCTTCAAGAGCATCATGAAGAAATCCCCCTTCAGC

GGCCCCACCGACCCCCGGCCCCCCCCCGGCGGATCGCCGTGCCCAGCCGGAGCAGCGCCAGCGTGCCCAAGCCCGCCCCCCA

GCCCTACCCCTTCACCAGCAGCCTGAGCACCATCAACTACGACGAGTTCCCCACCATGGTGTTCCCCAGCGGCCAGATCAGCC

AGGCCAGCGCCCTGGCCCCCGCCCCCCCCCAGGTGCTGCCCCAGGCCCCCGCCCCCGCCCCCGCCCCCGCCATGGTGAGCGCC

CTGGCCCAGGCCCCCGCCCCCGTGCCCGTGCTGGCCCCCGGCCCCCCCCAGGCCGTGGCCCCCCCCGCCCCCAAGCCCACCCA

GGCCGGCGAGGGCACCCTGAGCGAGGCCCTGCTGCAGCTGCAGTTCGACGACGAGGACCTGGGCGCCCTGCTGGGCAACAGCA

CCGACCCCGCCGTGTTCACCGACCTGGCCAGCGTGGACAACAGCGAGTTCCAGCAGCTGCTGAACCAGGGCATCCCCGTGGCC

CCCCACACCACCGAGCCCATGCTGATGGAGTACCCCGAGGCCATCACCCGGCTGGTGACCGGCGCCCAGCGGCCCCCCGACCC

CGCCCCCGCCCCCCTGGGCGCCCCCGGCCTGCCCAACGGCCTGCTGAGCGGCGACGAGGACTTCAGCAGCATCGCCGACATGG

ACTTCAGCGCCCTGCTGGGCAGCGGCAGCGGCAGCCGGGACAGCCGGGAGGGCATGTTCCTGCCCAAGCCCGAGGCCGGCAGC

GCCATCAGCGACGTGTTCGAGGGCCGGGAGGTGTGCCAGCCCAAGCGGCTCCGGCCCTTCCACCCCCCGGCAGCCCCTGGGC

CAACCGGCCCCTGCCCGCCAGCCTGGCCCCCACCCCCACCGGCCCCGTGCACGAGCCCGTGGGCAGCCTGACCCCCGCCCCCG

TGCCCCAGCCCCTGGACCCCGCCCCCGCCGTGACCCCCGAGGCCAGCCACCTGCTGGAGGACCCCGACGAGGAGACCAGCCAG

GCCGTGAAGGCCCTGCGGGAGATGGCCGACACCGTGATCCCCCAGAAGGAGGAGGCCGCCATCTGCGGCCAGATGGACCTGAG

CCACCCCCCCCCCGGGGCCACCTGGACGAGCTGACCACCACCCTGGAGAGCATGACCGAGGACCTGAACCTGGACAGCCCCC

TGACCCCCGAGCTGAACGAGATCCTGGACACCTTCCTGAACGACGAGTGCCTGCTGCACGCCATGCACATCAGCACCGGCCTG

AGCATCTTCGACACCAGCCTGTTCAGCGGCGGCAAGCGGCCCGCCGCCACCAAGAAGGCCGGCCAGGCCAAGAAGAAGAAGGG

CAGCTACCCCTACGACGTGCCCGACTACGCCTGAGCGGCCGCTTAATTAAGCTGCCTTCTGCGGGGCTTGCCTTCTGGCCATG

CCCTTCTTCTCTCCCTTGCACCTGTACCTCTTGGTCTTTGAATAAAGCCTGAGTAGGAAGTCTAGAAAAAAAAAAAAAAAAA

AAAAAAAAAAAAAAAAAAAAAAAAAAAAAAAAAAAAAAAAAAAAAAAAAAAAAAAAA
```

>TAL4 amino acid sequence

SEQ ID NO.: 195

GSHMVDLRTLGYSQQQQEKIKPKVRSTVAQHHEALVGHGFTHAHIVALSQHPAALGTVAVKYQDMIAALPEATHEAIVGVGKR
GAGARALEALLTVAGELRGPPLQLDTGQLLKIAKRGGVTAVEAVHAWRNALTGAPLULTPEQVVAIASHDGGKQALETVQRLL
PVLCQAHGLTPEQVVAIASHDGGKQALETVQRLLPVLCQAHGLTPEQVVAIASNIGGKQALETVQRLLPVLCQAHGLTPEQVV
AIASUNGGKQALETVQRLLPVLCQAHGLTPEQVVAIASHDGGKQALETVQRLLPVLCQAHGLTPEQVVAIASNIGGKQALETV
QRLLPVLCQAHGLTPEQVVAIASUNGGKQALETVQRLLPVLCQAHGLTPEQVVAIASNIGGKQALETVQRLLPVLCQAHGLTP
EQVVAIASUGGGKQALETVQRLLPVLCQAHGLTPEQVVAIASHDGGKQALETVQRLLPVLCQAHGLTPEQVVAIASUGGGKQA
LETVQRLLPVLCQAHGLTPEQVVAIASUGGGKQALETVQRLLPVLCQAHGLTPEQVVAIASHDGGKQALETVQRLLPVLCQAH
GLTPEQVVAIASHDGGKQALETVQRLLPVLCQAHGLTPEQVVAIASHDGGKQALETVQRLLPVLCQAHGLTPEQVVAIASNIG
GKQALETVQRLLPVLCQAHGLTPEQVVAIASUNGGKQALETVQRLLPVLCQAHGLTPEQVVAIASNIGGRPALESIVAQLSRP
DPALAALTNDHLVALACLGGRPALDAVKKGLPHAPALIKRTURRIPERTSHRVAS

>TAL4 mRNA sequence

SEQ ID NO.: 247

```
GGAUCCCAUAUGGUUGAUCUGCGUACCCUGGGUUAUAGCCAGCAGCAGCAAGAAAAAAUCAAACCGAAAGUUCGUAGCACCGU

UGCACAGCAUCAUGAAGCACUGGUUGGUCAUGGUUUUUACCCAUGCACAUAUUGUUGCACUGAGCCAGCAUCCGGCAGCACUGG

GCACCGUUGCAGUUAAAUAUCAGGAUAUGAUUGCAGCACUGCCGGAAGCAACCCAUGAAGCAAUUGUUGGUGUUGGUAAACGC

GGAGCUGGUGCACGUGCCCUGGAAGCACUGCUGACCGUUGCCGGUGAACUGCGUGGUCCGCCUCUGCAGCUGGAUACCGGUCA

GCUGCUGAAAAUUGCAAAACGUGGUGGUGUUACCGCAGUUGAAGCAGUUCAUGCAUGGCGUAAUGCACUGACCGGUGCACCGC

UGAAUCUGACACCGGAACAGGUUGUUGCAAUUGCCAGCCAUGAUGGUGGCAAACAGGCACUGGAAACCGUUCAGCGUCUGCUG

CCCGGUUCUGUGUCAGGCACAUGGUCUGACCCCUGAACAGGUGGUGGCCAUUGCAAGCCAUGACGGCGGUAAACAAGCCCUGGA
```

-continued

```
AACAGUGCAGCGCCUGUUACCGGUGCUGUGCCAGGCCCAUGGCUUAACUCCGGAACAGGUGGUAGCGAUCGCAUCAAACAUUG

GAGGUAAACAGGCCUUAGAAACCGUACAGCGCUUACUGCCGGUGUUAUGCCAGGCGCACGGCCUGACGCCAGAACAGGUAGUG

GCAAUCGCCUCAAAUAAUGGUGGAAAACAGGCGUUAGAGACAGUCCAGCGCCUGCUGCCUGUAUUAUGUCAAGCCCAUGGCCU

GACCCCAGAGCAAGUUGUUGCGAUUGCAAGUCAUGAUGGGGUAAACAGGCACUUGAGACAGUUCAACGUUUACUGCCUGUAC

UGUGCCAAGCUCACGGUCUGACUCCGGAACAAGUCGUCGCGAUUGCGAGUAAUAUCGGUGGCAAACAAGCAUUAGAAACGGUG

CAACGCCUGCUGCCAGUUCUUUGCCAGGCUCACGGUUUAACCCCUGAGCAGGUUGUAGCUAUUGCGAGUAACAAUGGUGGUAA

GCAGGCGUUGGAAACUGUGCAAAGACUGCUGCCCGUGUUGUGCCAAGCACAUGGUUUAACCCCAGAACAAGUCGUAGCAAUCG

CAAGCAAUAUAGGUGGCAAGCAAGCGCUUGAAACAGUACAGCGUUUAUUACCGGUACUUUGUCAGGCCCACGGUCUUACACCA

GAACAAGUUGUGGCCAUAGCCAGUAAUGGUGGCGGAAAGCAGGCUCUGGAAACGGUACAACGUCUGUUACCUGUUCUGUGUCA

AGCGCACGGAUUAACACCUGAACAAGUAGUUGCCAUUGCGUCACAUGACGGAGGCAAGCAGGCCUUGGAGACAGUGCAGAGAU

UACUGCCAGUGUUGUGUCAGGCUCAUGGCCUUACACCCGAGCAGGUCGUGGCAAUUGCAUCUAAUGGCGGCGGUAAGCAAGCU

UUAGAGACUGUUCAGAGACUGCUUCCUGUCCUGUGCCAGGCACACGGACUUACGCCUGAGCAAGUGGUUGCAAUCGCCUCUAA

UGGGGGUGGUAAGCAAGCACUGGAAACUGUCCAACGCUUACUUCCGGUGCUUUGUCAAGCACACGGCUUAACGCCAGAGCAGG

UCGUCGCCAUAGCCAGCCAUGAUGGUGGUAAACAGGCCCUUGAAACGGUCCAAAGACUUCUGCCGGUCCUUUGCCAAGCGCAU

GGGCUGACACCUGAGCAGGUAGUCGCGAUUGCCUCACAUGACGGUGGGAAGCAGGCAUUAGAAACAGUUCAAAGAUUAUUACC

AGUCCUGUGUCAGGCGCAUGGGUUAACCCCAGAGCAGGUAGUUGCAAUAGCAUCCCAUGAUGGCGGAAAACAAGCGUUGGAAA

CGGUUCAGCGGUUAUUGCCUGUUUUGUGCCAGGCGCAUGGUUUGACACCCGAGCAAGUGGUAGCCAUAGCCUCAAACAUUGGG

GGUAAACAAGCUUUGGAGACAGUACAACGGCUGCUUCCAGUUUUAUGUCAGGCCCAUGGAUUGACGCCUGAACAAGUUGUCGC

UAUCGCAAGUAAUAAUGGUGGUAAACAAGCGCUUGAAACCGUUCAACGCCUUCUGCCUCUGUGCUUUGUCAGGCACAUGGAUUAA

CACCCGAACAGGUUGUCGCGAUAGCUUCAAAUAUCGGUGGUCGUCCGGCACUGGAAAGCAUUGUUGCACAGCUGAGCCGUCCU

GAUCCGGCACUGGCAGCACUGACCAAUGAUCAUCUGGUUGCACUGGCAUGUCUGGGGUGUCGCCCUGCCCUGGAUGCAGUUAA

AAAAGGUCUGCCGCAUGCACCGGCACUGAUUAAACGUACCAAUCGUCGUAUUCCGGAACGUACCAGCCAUCGUGUUGCUAGC
```

>TAL5-VPR protein

SEQ ID NO.: 196

```
MAPKKKRKVGIHGVPAAGSSGSHMVDLRTLGYSQQQQEKIKPKVRSTVAQHHEALVGHGFTHAHIVALSQHPAALGTVAVKYQ

DMIAALPEATHEAIVGVGKRGAGARALEALLTVAGELRGPPLQLDTGQLLKIAKRGGVTAVEAVHAWRNALTGAPLNLTPEQV

VAIASNNGGKQALETVQRLLPVLCQAHGLTPEQVVAIASNNGGKQALETVQRLLPVLCQAHGLTPEQVVAIASNNGGKQALET

VQRLLPVLCQAHGLTPEQVVAIASNNGGKQALETVQRLLPVLCQAHGLTPEQVVAIASNNGGKQALETVQRLLPVLCQAHGLT

PEQVVAIASNIGGKQALETVQRLLPVLCQAHGLTPEQVVAIASHDGGKQALETVQRLLPVLCQAHGLTPEQVVAIASHDGGKQ

ALETVQRLLPVLCQAHGLTPEQVVAIASNNGGKQALETVQRLLPVLCQAHGLTPEQVVAIASNIGGKQALETVQRLLPVLCQA

HGLTPEQVVAIASNGGGKQALETVQRLLPVLCQAHGLTPEQVVAIASNGGGKQALETVQRLLPVLCQAHGLTPEQVVAIASNI

GGKQALETVQRLLPVLCQAHGLTPEQVVAIASNIGGKQALETVQRLLPVLCQAHGLTPEQVVAIASHDGGKQALETVQRLLPV

LCQAHGLTPEQVVAIASHDGGKQALETVQRLLPVLCQAHGLTPEQVVAIASNIGGKQALETVQRLLPVLCQAHGLTPEQVVAI

ASNGGGRPALESIVAQLSRPDPALAALTNDHLVALACLGGRPALDAVKKGLPHAPALIKRTNRRIPERTSHRVASGSGGGSGG

DALDDFDLDMLGSDALDDFDLDMLGSDALDDFDLDMLGSDALDDFDLDMLSGGPKKKRKVGSQYLPDTDDRHRIEEKRKRTYE

TFKSIMKKSPFSGPTDPRPPPRRIAVPSRSSASVPKPAPQPYPFTSSLSTINYDEFPTMVFPSGQISQASALAPAPPQVLPQA

PAPAPAPAMVSALAQAPAPVPVLAPGPPQAVAPPAPKPTQAGEGTLSEALLQLQFDDEDLGALLGNSTDPAVFTDLASVDNSE

FQQLLNQGIPVAPHTTEPMLMEYPEAITRLVTGAQRPPDPAPAPLGAPGLPNGLLSGDEDFSSIADMDFSALLGSGSGSRDSR

EGMFLPKPEAGSAISDVFEGREVCQPKRLRPFHPPGSPWANRPLPASLAPTPTGPVHEPVGSLTPAPVPQPLDPAPAVTPEAS

HLLEDPDEETSQAVKALREMADTVIPQKEEAAICGQMDLSHPPPRGHLDELTTTLESMTEDLNLDSPLTPELNEILDTFLNDE

CLLHAMHISTGLSIFDTSLFSGGKRPAATKKAGQAKKKKGSYPYDVPDYA
```

>TAL5-VPR mRNA

SEQ ID NO.: 197

AGGAAATAAGAGAGAAAAGAAGAGTAAGAAGAAATATAAGAGCCACCATGGCCCCCAAGAAGAAGCGGAAGGTGGGCATCCAC

GGCGTGCCCGCCGCCGGCAGCAGCGGATCCCATATGGTTGATCTGCGTACCCTGGGTTATAGCCAGCAGCAGCAAGAAAAAT

CAAACCGAAAGTTCGTAGCACCGTTGCACAGCATCATGAAGCACTGGTTGGTCATGGTTTTACCCATGCACATATTGTTGCAC

TGAGCCAGCATCCGGCAGCACTGGGCACCGTTGCAGTTAAATATCAGGATATGATTGCAGCACTGCCGGAAGCAACCCATGAA

GCAATTGTTGGTGTTGGTAAACGCGGAGCTGGTGCACGTGCCCTGGAAGCACTGCTGACCGTTGCCGGTGAACTGCGTGGTCC

GCCTCTGCAGCTGGATACCGGTCAGCTGCTGAAAATTGCAAAACGTGGTGGTGTTACCGCAGTTGAAGCAGTTCATGCATGGC

GTAATGCACTGACCGGTGCACCGCTGAATCTGACACCGGAACAGGTTGTTGCAATTGCCAGCAATAATGGTGGCAAACAGGCA

CTGGAAACCGTTCAGCGTCTGCTGCCGGTTCTGTGTCAGGCACATGGTCTGACCCCTGAACAGGTGGTGGCCATTGCAAGCAA

CAATGGCGGTAAACAAGCCCTGGAAACAGTGCAGCGCCTGTTACCGGTGCTGTGCCAGGCCCATGGCTTAACTCCGGAACAGG

TGGTAGCGATCGCATCAAATAATGGAGGTAAACAGGCCTTAGAAACCGTACAGCGCTTACTGCCGGTGTTATGCCAGGCGCAC

GGCCTGACGCCAGAACAGGTAGTGGCAATCGCCTCAAACAATGGTGGAAAACAGGCGTTAGAGACAGTCCAGCGCCTGCTGCC

TGTATTATGTCAAGCCCATGGCCTGACCCCAGAGCAAGTTGTTGCGATTGCAAGTAATAATGGGGGTAAACAGGCACTTGAGA

CAGTTCAACGTTTACTGCCTGTACTGTGCCAAGCTCACGGTCTGACTCCGGAACAAGTCGTCGCGATTGCGAGTAACATTGGT

GGCAAACAAGCATTAGAAACGGTGCAACGCCTGCTGCCAGTTCTTTGCCAGGCTCACGGTTTAACCCCTGAGCAGGTTGTAGC

TATTGCGAGTCATGATGGTGGTAAGCAGGCGTTGGAAACTGTGCAAAGACTGCTGCCCGTGTTGTGCCAAGCACATGGTTTAA

CCCCAGAACAAGTCGTAGCAATCGCAAGCCATGACGGTGGCAAGCAAGCGCTTGAAACAGTACAGCGTTTATTACCGGTACTT

TGTCAGGCCCACGGTCTTACACCAGAACAAGTTGTGGCCATAGCCAGTAACAATGGCGGAAAGCAGGCTCTGGAAACGGTACA

ACGTCTGTTACCTGTTCTGTGTCAAGCGCACGGATTAACACCTGAACAAGTAGTTGCCATTGCGTCAAATATCGGAGGCAAGC

AGGCCTTGGAGACAGTGCAGAGATTACTGCCAGTGTTGTGTCAGGCTCATGGCCTTACACCCGAGCAGGTCGTGGCAATTGCA

TCTAATGGTGGCGGTAAGCAAGCTTTAGAGACTGTTCAGAGACTGCTTCCTGTCCTGTGCCAGGCACACGGACTTACGCCTGA

GCAAGTGGTTGCAATCGCCTCTAATGGCGGTGGTAAGCAAGCACTGGAAACTGTCCAACGCTTACTTCCGGTGCTTTGTCAAG

CACACGGCTTAACGCCAGAGCAGGTCGTCGCCATAGCCAGCAATATAGGTGGTAAACAGGCCCTTGAAACGGTCCAAAGACTT

CTGCCGGTCCTTTGCCAAGCGCATGGGCTGACACCTGAGCAGGTAGTCGCGATTGCCTCAAACATTGGTGGGAAGCAGGCATT

AGAAACAGTTCAAAGATTATTACCAGTCCTGTGTCAGGCGCATGGGTTAACCCCAGAGCAGGTAGTTGCAATAGCATCCCATG

ATGGCGGAAAACAAGCGTTGGAAACGGTTCAGCGGTTATTGCCTGTTTTGTGCCAGGCGCATGGTTTGACACCCGAGCAAGTG

GTAGCCATAGCCTCACATGACGGGGGTAAACAAGCTTTGGAGACAGTACAACGGCTGCTTCCAGTTTTATGTCAGGCCCATGG

ATTGACGCCTGAACAAGTTGTCGCTATCGCAAGTAATATCGGTGGTAAACAAGCGCTTGAAACCGTTCAACGCCTTCTGCCTG

TGCTTTGTCAGGCACATGGATTAACACCCGAACAGGTTGTCGCGATAGCTTCAAATGGGGGTGGTCGTCGGCACTGGAAAGC

ATTGTTGCACAGCTGAGCCGTCCTGATCCGGCACTGGCAGCACTGACCAATGATCATCTGGTTGCACTGGCATGTCTGGGTGG

TCGCCCTGCCCTGGATGCAGTTAAAAAAGGTCTGCCGCATGCACCGGCACTGATTAAACGTACCAATCGTCGTATTCCGGAAC

GTACCAGCCATCGTGTTGCTAGCGGCAGCGGCGGCGGCAGCGGCGGCGACGCCCTGGACGACTTCGACCTGGACATGCTGGGC

AGCGACGCCCTGGACGACTTCGACCTGGACATGCTGGGCAGCGACGCCCTGGACGACTTCGACCTGGACATGCTGGGCAGCGA

CGCCCTGGACGACTTCGACCTGGACATGCTGAGCGGCGGCCCCAAGAAGAAGCGGAAGGTGGGCAGCCAGTACCTGCCCGACA

CCGACGACCGGCACCGGATCGAGGAGAAGCGGAAGCGGACCTACGAGACCTTCAAGAGCATCATGAAGAAATCCCCCTTCAGC

GGCCCCACCGACCCCCGGCCCCCCCCCGGCGGATCGCCGTGCCCAGCCGGAGCAGCGCCAGCGTGCCCAAGCCCGCCCCCCA

GCCCTACCCCTTCACCAGCAGCCTGAGCACCATCAACTACGACGAGTTCCCCACCATGGTGTTCCCCAGCGGCCAGATCAGCC

AGGCCAGCGCCCTGGCCCCCGCCCCCCCCAGGTGCTGCCCCAGGCCCCCGCCCCGCCCCCGCCCCCGCCATGGTGAGCGCC

CTGGCCCAGGCCCCCGCCCCCGTGCCCGTGCTGGCCCCCGGCCCCCCCCAGGCCGTGGCCCCCCCCGCCCCCAAGCCCACCCA

GGCCGGCGAGGGCACCCTGAGCGAGGCCCTGCTGCAGCTGCAGTTCGACGACGAGGACCTGGGCGCCCTGCTGGGCAACAGCA

-continued

```
CCGACCCCGCCGTGTTCACCGACCTGGCCAGCGTGGACAACAGCGAGTTCCAGCAGCTGCTGAACCAGGGCATCCCCGTGGCC

CCCCACACCACCGAGCCCATGCTGATGGAGTACCCCGAGGCCATCACCCGGCTGGTGACCGGCGCCCAGCGGCCCCCCGACCC

CGCCCCCGCCCCCTGGGCGCCCCCGGCCTGCCCAACGGCCTGCTGAGCGGCGACGAGGACTTCAGCAGCATCGCCGACATGG

ACTTCAGCGCCCTGCTGGGCAGCGGCAGCGGCAGCCGGGACAGCCGGGAGGGCATGTTCCTGCCCAAGCCCGAGGCCGGCAGC

GCCATCAGCGACGTGTTCGAGGGCCGGGAGGTGTGCCAGCCCAAGCGGCTCCGGCCCTTCCACCCCCCCGGCAGCCCCTGGGC

CAACCGGCCCCTGCCCGCCAGCCTGGCCCCCACCCCCACCGGCCCCGTGCACGAGCCCGTGGGCAGCCTGACCCCCGCCCCCG

TGCCCCAGCCCCTGGACCCCGCCCCCGCCGTGACCCCCGAGGCCAGCCACCTGCTGGAGGACCCCGACGAGGAGACCAGCCAG

GCCGTGAAGGCCCTGCGGGAGATGGCCGACACCGTGATCCCCCAGAAGGAGGAGGCCGCCATCTGCGGCCAGATGGACCTGAG

CCACCCCCCCCCCGGGGCCACCTGGACGAGCTGACCACCACCCTGGAGAGCATGACCGAGGACCTGAACCTGGACAGCCCCC

TGACCCCCGAGCTGAACGAGATCCTGGACACCTTCCTGAACGACGAGTGCCTGCTGCACGCCATGCACATCAGCACCGGCCTG

AGCATCTTCGACACCAGCCTGTTCAGCGGCGGCAAGCGGCCCGCCGCCACCAAGAAGGCCGGCCAGGCCAAGAAGAAGAAGGG

CAGCTACCCCTACGACGTGCCCGACTACGCCTGAGCGGCCGCTTAATTAAGCTGCCTTCTGCGGGGCTTGCCTTCTGGCCATG

CCCTTCTTCTCTCCCTTGCACCTGTACCTCTTGGTCTTTGAATAAAGCCTGAGTAGGAAGTCTAGAAAAAAAAAAAAAAAAAA

AAAAAAAAAAAAAAAAAAAAAAAAAAAAAAAAAAAAAAAAAAAAAAAAAAAAAAAAAA
```

>TAL5 amino acid

SEQ ID NO.: 198

```
GSHMVDLRTLGYSQQQQEKIKPKVRSTVAQHHEALVGHGFTHAHIVALSQHPAALGTVAVKYQDMIAALPEATHEAIVGVGKR

GAGARALEALLTVAGELRGPPLQLDTGQLLKIAKRGGVTAVEAVHAWRNALTGAPLULTPEQVVAIASUNGGKQALETVQRLL

PVLCQAHGLTPEQVVAIASUNGGKQALETVQRLLPVLCQAHGLTPEQVVAIASUNGGKQALETVQRLLPVLCQAHGLTPEQVV

AIASUNGGKQALETVQRLLPVLCQAHGLTPEQVVAIASUNGGKQALETVQRLLPVLCQAHGLTPEQVVAIASNIGGKQALETV

QRLLPVLCQAHGLTPEQVVAIASHDGGKQALETVQRLLPVLCQAHGLTPEQVVAIASHDGGKQALETVQRLLPVLCQAHGLTP

EQVVAIASUNGGKQALETVQRLLPVLCQAHGLTPEQVVAIASNIGGKQALETVQRLLPVLCQAHGLTPEQVVAIASUGGGKQA

LETVQRLLPVLCQAHGLTPEQVVAIASUGGGKQALETVQRLLPVLCQAHGLTPEQVVAIASNIGGKQALETVQRLLPVLCQAH

GLTPEQVVAIASNIGGKQALETVQRLLPVLCQAHGLTPEQVVAIASHDGGKQALETVQRLLPVLCQAHGLTPEQVVAIASHDG

GKQALETVQRLLPVLCQAHGLTPEQVVAIASNIGGKQALETVQRLLPVLCQAHGLTPEQVVAIASUGGGRPALESIVAQLSRP

DPALAALTNDHLVALACLGGRPALDAVKKGLPHAPALIKRTURRIPERTSHRVAS
```

>TAL5 mRNA

SEQ ID NO.: 248

```
GGAUCCCAUAUGGUUGAUCUGCGUACCCUGGGUUAUAGCCAGCAGCAGCAAGAAAAAAUCAAACCGAAAGUUCGUAGCACCGU

UGCACAGCAUCAUGAAGCACUGGUUGGUCAUGGUUUUACCCAUGCACAUAUUGUUGCACUGAGCCAGCAUCCGGCAGCACUGG

GCACCGUUGCAGUUAAAUAUCAGGAUAUGAUUGCAGCACUGCCGGAAGCAACCCAUGAAGCAAUUGUUGGUGUUGGUAAACGC

GGAGCUGGUGCACGUGCCCUGGAAGCACUGCUGACCGUUGCCGGUGAACUGCGUGGUCCGCCUCUGCAGCUGGAUACCGGUCA

GCUGCUGAAAAUUGCAAAACGUGGUGGUGUUACCGCAGUUGAAGCAGUUCAUGCAUGGCGUAAUGCACUGACCGGUGCACCGC

UGAAUCUGACACCGGAACAGGUUGUUGCAAUUGCCAGCAAUAAUGGUGGCAAACAGGCACUGGAAACCGUUCAGCGUCUGCUG

CCGGUUCUGUGUCAGGCACAUGGUCUGACCCCUGAACAGGUGGUGGCCAUUGCAAGCAACAAUGGCGGUAAACAAGCCCUGGA

AACAGUGCAGCGCCUGUUACCGGUGCUGUGCCAGGCCCAUGGCUUAACUCCGGAACAGGUGGUAGCGAUCGCAUCAAAUAAUG

GAGGUAAACAGGCCUUAGAAACCGUACAGCGCUUACUGCCGGUGUUAUGCCAGGCGCACGGCCUGACGCCAGAACAGGUAGUG

GCAAUCGCCUCAAACAAUGGUGGAAAACAGGCGUUAGAGACAGUCCAGCGCCUGCUGCCGUAUUAUGUCAAGCCCAUGGCCU

GACCCCAGAGCAAGUUGUUGCGAUUGCAAGUAAUAAUGGGGGUAAACAGGCACUUGAGACAGUUCAACGUUUACUGCCUGUAC

UGUGCCAAGCUCACGGUCUGACUCCGAACAAGUCGUCGAUUGCAGUAACAUUGGUGGCAAACAAGCAUUAGAAACGGUG

CAACGCCUGCUGCCAGUUCUUUGCCAGGCUCACGGUUUAACCCCUGAGCAGGUUGUAGCUAUUGCGAGUCAUGAUGGUGGUAA

GCAGGCGUUGGAAACUGUGCAAAGACUGCUGCCCGUGUUGUGCCAAGCACAUGGUUUAACCCCAGAACAAGUCGUAGCAAUCG

CAAGCCAUGACGGUGGCAAGCAAGCGCUUGAAACAGUACAGCGUUUAUUACCGGUACUUUGUCAGGCCCACGGUCUUACACCA
```

-continued

```
GAACAAGUUGUGGCCAUAGCCAGUAACAAUGGCGGAAAGCAGGCUCUGGAAACGGUACAACGUCUGUUACCUGUUCUGUGUCA

AGCGCACGGAUUAACACCUGAACAAGUAGUUGCCAUUGCGUCAAAUAUCGGAGGCAAGCAGGCCUUGGAGACAGUGCAGAGAU

UACUGCCAGUGUUGUGUCAGGCUCAUGGCCUUACACCCGAGCAGGUCGUGGCAAUUGCAUCUAAUGGUGGCGGUAAGCAAGCU

UUAGAGACUGUUCAGAGACUGCUUCCUGUCCUGUGCCAGGCACACGGACUUACGCCUGAGCAAGUGGUUGCAAUCGCCUCUAA

UGGCGGUGGUAAGCAAGCACUGGAAACUGUCCAACGCUUACUUCCGGUGCUUUGUCAAGCACACGGCUUAACGCCAGAGCAGG

UCGUCGCCAUAGCCAGCAAUAUAGGUGGUAAACAGGCCCUUGAAACGGUCCAAAGACUUCUGCCGGUCCUUUGCCAAGCGCAU

GGGCUGACACCUGAGCAGGUAGUCGCGAUUGCCUCAAACAUUGGUGGGAAGCAGGCAUUAGAAACAGUUCAAAGAUUAUUACC

AGUCCUGUGUCAGGCGCAUGGGUUAACCCCAGAGCAGGUAGUUGCAAUAGCAUCCCAUGAUGGCGGAAAACAAGCGUUGGAAA

CGGUUCAGCGGUUAUUGCCUGUUUUGUGCCAGGCGCAUGGUUUGACACCCGAGCAAGUGGUAGCCAUAGCCUCACAUGACGGG

GGUAAACAAGCUUUGGAGACAGUACAACGGCUGCUUCCAGUUUUAUGUCAGGCCCAUGGAUUGACGCCUGAACAAGUUGUCGC

UAUCGCAAGUAAUAUCGGUGGUAAACAAGCGCUUGAAACCGUUCAACGCCUUCUGCCUGUGCUUUGUCAGGCACAUGGAUUAA

CACCCGAACAGGUUGUCGCGAUAGCUUCAAAUGGGGUGGUCGUCCGGCACUGGAAAGCAUUGUUGCACAGCUGAGCCGUCCU

GAUCCGGCACUGGCAGCACUGACCAAUGAUCAUCUGGUUGCACUGGCAUGUCUGGGUGGUCGCCCUGCCCUGGAUGCAGUUAA

AAAAGGUCUGCCGCAUGCACCGGCACUGAUUAAACGUACCAAUCGUCGUAUUCCGGAACGUACCAGCCAUCGUGUUGCUAGC
```

>TAL6-VPR protein

SEQ ID NO.: 199

```
MAPKKKRKVGIHGVPAAGSSGSHMVDLRTLGYSQQQQEKIKPKVRSTVAQHHEALVGHGFTHAHIVALSQHPAALGTVAVKYQ
DMIAALPEATHEAIVGVGKRGAGARALEALLTVAGELRGPPLQLDTGQLLKIAKRGGVTAVEAVHAWRNALTGAPLULTPEQV
VAIASUNGGKQALETVQRLLPVLCQAHGLTPEQVVAIASUNGGKQALETVQRLLPVLCQAHGLTPEQVVAIASNGGGKQALET
VQRLLPVLCQAHGLTPEQVVAIASUNGGKQALETVQRLLPVLCQAHGLTPEQVVAIASUGGGKQALETVQRLLPVLCQAHGLT
PEQVVAIASHDGGKQALETVQRLLPVLCQAHGLTPEQVVAIASNIGGKQALETVQRLLPVLCQAHGLTPEQVVAIASUNGGKQ
ALETVQRLLPVLCQAHGLTPEQVVAIASHDGGKQALETVQRLLPVLCQAHGLTPEQVVAIASHDGGKQALETVQRLLPVLCQA
HGLTPEQVVAIASNIGGKQALETVQRLLPVLCQAHGLTPEQVVAIASNNGGKQALETVQRLLPVLCQAHGLTPEQVVAIASNI
GGKQALETVQRLLPVLCQAHGLTPEQVVAIASNIGGKQALETVQRLLPVLCQAHGLTPEQVVAIASNIGGKQALETVQRLLPV
LCQAHGLTPEQVVAIASHDGGKQALETVQRLLPVLCQAHGLTPEQVVAIASHDGGKQALETVQRLLPVLCQAHGLTPEQVVAI
ASNIGGRPALESIVAQLSRPDPALAALTNDHLVALACLGGRPALDAVKKGLPHAPALIKRTNRRIPERTSHRVASGSGGGSGG
DALDDFDLDMLGSDALDDFDLDMLGSDALDDFDLDMLGSDALDDFDLDMLSGGPKKKRKVGSQYLPDTDDRHRIEEKRKRTYE
TFKSIMKKSPFSGPTDPRPPPRRIAVPSRSSASVPKPAPQPYPFTSSLSTINYDEFPTMVFPSGQISQASALAPAPPQVLPQA
PAPAPAPAMVSALAQAPAPVPVLAPGPPQAVAPPAPKPTQAGEGTLSEALLQLQFDDEDLGALLGNSTDPAVFTDLASVDNSE
FQQLLNQGIPVAPHTTEPMLMEYPEAITRLVTGAQRPPDPAPAPLGAPGLPNGLLSGDEDFSSIADMDFSALLGSGSGSRDSR
EGMFLPKPEAGSAISDVFEGREVCQPKRLRPFHPPGSPWANRPLPASLAPTPTGPVHEPVGSLTPAPVPQPLDPAPAVTPEAS
HLLEDPDEETSQAVKALREMADTVIPQKEEAAICGQMDLSHPPPRGHLDELTTTLESMTEDLNLDSPLTPELNEILDTFLNDE
CLLHAMHISTGLSIFDTSLFSGGKRPAATKKAGQAKKKKGSYPYDVPDY*
```

>TAL6-VPR mRNA

SEQ ID NO.: 200

```
AGGAAATAAGAGAGAAAGAAGAGTAAGAAGAAATATAAGAGCCACCATGGCCCCCAAGAAGAAGCGGAAGGTGGGCATCCAC

GGCGTGCCCGCCGCCGGCAGCAGCGGATCCCATATGGTTGATCTGCGTACCCTGGGTTATAGCCAGCAGCAGCAAGAAAAAAT

CAAACCGAAAGTTCGTAGCACCGTTGCACAGCATCATGAAGCACTGGTTGGTCATGGTTTTACCCATGCACATATTGTTGCAC

TGAGCCAGCATCCGGCAGCACTGGGCACCGTTGCAGTTAAATATCAGGATATGATTGCAGCACTGCCGGAAGCAACCCATGAA

GCAATTGTTGGTGTTGGTAAACGCGGAGCTGGTGCACGTGCCCTGGAAGCACTGCTGACCGTTGCCGGTGAACTGCGTGGTCC

GCCTCTGCAGCTGGATACCGGTCAGCTGCTGAAAATTGCAAAACGTGGTGGTGTTACCGCAGTTGAAGCAGTTCATGCATGGC

GTAATGCACTGACCGGTGCACCGCTGAATCTGACACCGGAACAGGTTGTTGCAATTGCCAGCAATAATGGTGGCAAACAGGCA
```

-continued

```
CTGGAAACCGTTCAGCGTCTGCTGCCGGTTCTGTGTCAGGCACATGGTCTGACCCCTGAACAGGTGGTGGCCATTGCAAGCAA
CAATGGCGGTAAACAAGCCCTGGAAACAGTGCAGCGCCTGTTACCGGTGCTGTGCCAGGCCCATGGCTTAACTCCGGAACAGG
TGGTAGCGATCGCATCAAATGGTGGAGGTAAACAGGCCTTAGAAACCGTACAGCGCTTACTGCCGGTGTTATGCCAGGCGCAC
GGCCTGACGCCAGAACAGGTAGTGGCAATCGCCTCAAATAATGGTGGAAAACAGGCGTTAGAGACAGTCCAGCGCCTGCTGCC
TGTATTATGTCAAGCCCATGGCCTGACCCCAGAGCAAGTTGTTGCGATTGCAAGTAATGGCGGGGGTAAACAGGCACTTGAGA
CAGTTCAACGTTTACTGCCTGTACTGTGCCAAGCTCACGGTCTGACTCCGGAACAAGTCGTCGCGATTGCGAGTCATGATGGT
GGCAAACAAGCATTAGAAACGGTGCAACGCCTGCTGCCAGTTCTTTGCCAGGCTCACGGTTTAACCCCTGAGCAGGTTGTAGC
TATTGCGAGTAACATTGGTGGTAAGCAGGCGTTGGAAACTGTGCAAAGACTGCTGCCCGTGTTGTGCCAAGCACATGGTTTAA
CCCCAGAACAAGTCGTAGCAATCGCAAGCAACAATGGTGGCAAGCAAGCGCTTGAAACAGTACAGCGTTTATTACCGGTACTT
TGTCAGGCCCACGGTCTTACACCAGAACAAGTTGTGGCCATAGCCAGTCATGACGGCGGAAAGCAGGCTCTGGAAACGGTACA
ACGTCTGTTACCTGTTCTGTGTCAAGCGCACGGATTAACACCTGAACAAGTAGTTGCCATTGCGTCACATGATGGAGGCAAGC
AGGCCTTGGAGACAGTGCAGAGATTACTGCCAGTGTTGTGTCAGGCTCATGGCCTTACACCCGAGCAGGTCGTGGCAATTGCA
TCTAATATCGGCGGTAAGCAAGCTTTAGAGACTGTTCAGAGACTGCTTCCTGTCCTGTGCCAGGCACACGGACTTACGCCTGA
GCAAGTGGTTGCAATCGCCTCTAATAATGGTGGTAAGCAAGCACTGGAAACTGTCCAACGCTTACTTCCGGTGCTTTGTCAAG
CACACGCTTAACGCCAGAGCAGGTCGTCGCCATAGCCAGCAATATAGGTGGTAAACAGGCCCTTGAAACGGTCCAAAGACTT
CTGCCGGTCCTTTGCCAAGCGCATGGGCTGACACCTGAGCAGGTAGTCGCGATTGCCTCAAACATTGGTGGGAAGCAGGCATT
AGAAACAGTTCAAAGATTATTACCAGTCCTGTGTCAGGCGCATGGGTTAACCCCAGAGCAGGTAGTTGCAATAGCATCCAATA
TCGGCGGAAAACAAGCGTTGGAAACGGTTCAGCGGTTATTGCCTGTTTTGTGCCAGGCGCATGGTTTGACACCCGAGCAAGTG
GTAGCCATAGCCTCACATGATGGGGGTAAACAAGCTTTGGAGACAGTACAACGGCTGCTTCCAGTTTTATGTCAGGCCCATGG
ATTGACGCCTGAACAAGTTGTCGCTATCGCAAGTCATGACGGTGGTAAACAAGCGCTTGAAACCGTTCAACGCCTTCTGCCTG
TGCTTTGTCAGGCACATGGATTAACACCCGAACAGGTTGTCGCGATAGCTTCAAATATAGGTGGTCGTCCGGCACTGGAAAGC
ATTGTTGCACAGCTGAGCCGTCCTGATCCGGCACTGGCAGCACTGACCAATGATCATCTGGTTGCACTGGCATGTCTGGGTGG
TCGCCCTGCCCTGGATGCAGTTAAAAAAGGTCTGCCGCATGCACCGGCACTGATTAAACGTACCAATCGTCGTATTCCGGAAC
GTACCAGCCATCGTGTTGCTAGCGGCAGCGGCGGCGGCAGCGGCGGCGACGCCCTGGACGACTTCGACCTGGACATGCTGGGC
AGCGACGCCCTGGACGACTTCGACCTGGACATGCTGGGCAGCGACGCCCTGGACGACTTCGACCTGGACATGCTGGGCAGCGA
CGCCCTGGACGACTTCGACCTGGACATGCTGAGCGGCGGCCCCAAGAAGAAGCGGAAGGTGGGCAGCCAGTACCTGCCCGACA
CCGACGACCGGCACCGGATCGAGGAGAAGCGGAAGCGGACCTACGAGACCTTCAAGAGCATCATGAAGAAATCCCCCTTCAGC
GGCCCCACCGACCCCGGCCCCCCCCCGGCGGATCGCCGTGCCCAGCCGGAGCAGCGCCAGCGTGCCCAAGCCCGCCCCCCA
GCCCTACCCCTTCACCAGCAGCCTGAGCACCATCAACTACGACGAGTTCCCCACCATGGTGTTCCCCAGCGGCCAGATCAGCC
AGGCCAGCGCCCTGGCCCCCGCCCCCCCCAGGTGCTGCCCCAGGCCCCCGCCCCCGCCCCCGCCCCGCCATGGTGAGCGCC
CTGGCCCAGGCCCCCGCCCCCGTGCCCGTGCTGGCCCCCGGCCCCCCCAGGCCGTGGCCCCCCCGCCCCCAAGCCCACCCA
GGCCGGCGAGGGCACCCTGAGCGAGGCCCTGCTGCAGCTGCAGTTCGACGACGAGGACCTGGGCGCCCTGCTGGGCAACAGCA
CCGACCCCGCCGTGTTCACCGACCTGGCCAGCGTGGACAACAGCGAGTTCCAGCAGCTGCTGAACCAGGGCATCCCCGTGGCC
CCCCACACCACCGAGCCCATGCTGATGGAGTACCCCGAGGCCATCACCCGGCTGGTGACCGGCGCCCAGCGGCCCCCCGACCC
CGCCCCCGCCCCCTGGGCGCCCCCGGCCTGCCCAACGGCCTGCTGAGCGGCGACGAGGACTTCAGCAGCATCGCCGACATGG
ACTTCAGCGCCCTGCTGGGCAGCGGCAGCGGCAGCCGGGACAGCGGGAGGGCATGTTCCTGCCCAAGCCCGAGGCCGGCAGC
GCCATCAGCGACGTGTTCGAGGGCCGGGAGGTGTGCCAGCCCAAGCGGCTCCGGCCCTTCCACCCCCCCGGCAGCCCCTGGGC
CAACCGGCCCCTGCCCGCCAGCCTGGCCCCCACCCCCACCGGCCCCGTGCACGAGCCCGTGGGCAGCCTGACCCCCGCCCCCG
TGCCCCAGCCCCTGGACCCCGCCCCCGCCGTGACCCCCGAGGCCAGCCACCTGCTGGAGGACCCCGACGAGGAGACCAGCCAG
GCCGTGAAGGCCCTGCGGGAGATGGCCGACACCGTGATCCCCCAGAAGGAGGAGGCCGCCATCTGCGGCCAGATGGACCTGAG
CCACCCCCCCCCCCGGGGCCACCTGGACGAGCTGACCACCACCCCTGGAGAGCATGACCGAGGACCTGAACCTGGACAGCCCCC
```

```
TGACCCCCGAGCTGAACGAGATCCTGGACACCTTCCTGAACGACGAGTGCCTGCTGCACGCCATGCACATCAGCACCGGCCTG

AGCATCTTCGACACCAGCCTGTTCAGCGGCGGCAAGCGGCCCGCCGCCACCAAGAAGGCCGGCCAGGCCAAGAAGAAGAAGGG

CAGCTACCCCTACGACGTGCCCGACTACGCCTGAGCGGCCGCTTAATTAAGCTGCCTTCTGCGGGGCTTGCCTTCTGGCCATG

CCCTTCTTCTCTCCCTTGCACCTGTACCTCTTGGTCTTTGAATAAAGCCTGAGTAGGAAGTCTAGAAAAAAAAAAAAAAAAAA

AAAAAAAAAAAAAAAAAAAAAAAAAAAAAAAAAAAAAAAAAAAAAAAAAAAAAAAAAA
```

>TAL6 amino acid sequence

SEQ ID NO.: 201

```
GSHMVDLRTLGYSQQQQEKIKPKVRSTVAQHHEALVGHGFTHAHIVALSQHPAALGTVAVKYQDMIAALPEATHEAIVGVGKR

GAGARALEALLTVAGELRGPPLQLDTGQLLKIAKRGGVTAVEAVHAWRNALTGAPLULTPEQVVAIASUNGGKQALETVQRLL

PVLCQAHGLTPEQVVAIASUNGGKQALETVQRLLPVLCQAHGLTPEQVVAIASUGGGKQALETVQRLLPVLCQAHGLTPEQVV

AIASUNGGKQALETVQRLLPVLCQAHGLTPEQVVAIASUGGGKQALETVQRLLPVLCQAHGLTPEQVVAIASHDGGKQALETV

QRLLPVLCQAHGLTPEQVVAIASNIGGKQALETVQRLLPVLCQAHGLTPEQVVAIASUNGGKQALETVQRLLPVLCQAHGLTP

EQVVAIASHDGGKQALETVQRLLPVLCQAHGLTPEQVVAIASHDGGKQALETVQRLLPVLCQAHGLTPEQVVAIASNIGGKQA

LETVQRLLPVLCQAHGLTPEQVVAIASUNGGKQALETVQRLLPVLCQAHGLTPEQVVAIASNIGGKQALETVQRLLPVLCQAH

GLTPEQVVAIASNIGGKQALETVQRLLPVLCQAHGLTPEQVVAIASNIGGKQALETVQRLLPVLCQAHGLTPEQVVAIASHDG

GKQALETVQRLLPVLCQAHGLTPEQVVAIASHDGGKQALETVQRLLPVLCQAHGLTPEQVVAIASNIGGRPALESIVAQLSRP

DPALAALTNDHLVALACLGGRPALDAVKKGLPHAPALIKRTURRIPERTSHRVAS
```

>TAL6 mRNA sequence

SEQ ID NO.: 249

```
GGAUCCCAUAUGGUUGAUCUGCGUACCCUGGGUUUAUAGCCAGCAGCAGCAAGAAAAAAUCAAACCGAAAGUUCGUAGCACCGU

UGCACAGCAUCAUGAAGCACUGGUUGGUCAUGGUUUUACCCAUGCACAUAUUGUUGCACUGAGCCAGCAUCCGGCAGCACUGG

GCACCGUUGCAGUUAAAUAUCAGGAUAUGAUUGCAGCACUGCCGGAAGCAACCCAUGAAGCAAUUGUUGGUGUUGGUAAACGC

GGAGCUGGUGCACGUGCCCUGGAAGCACUGCUGACCGUUGCCGGUGAACUGCGUGGUCCGCCUCUGCAGCUGGAUACCGGUCA

GCUGCUGAAAAUUGCAAAACGUGGUGGUGUUACCGCAGUUGAAGCAGUUCAUGCAUGGCGUAAUGCACUGACCGGUGCACCGC

UGAAUCUGACACCGGAACAGGUUGUUGCAAUUGCCAGCAAUAAUGGUGGCAAACAGGCACUGGAAACCGUUCAGCGUCUGCUG

CCGGUUCUGUGUCAGGCACAUGGUCUGACCCCUGAACAGGUGGUGGCCAUUGCAAGCAACAAUGGCGGUAAACAAGCCCUGGA

AACAGUGCAGCGCCUGUUACCGGUGCUGUGCCAGGCCCAUGGCUUAACUCCGGAACAGGUGGUAGCGAUCGCAUCAAAUGGUG

GAGGUAAACAGGCCUUAGAAACCGUACAGCGCUUACUGCCGGUGUUAUGCCAGGCGCACGGCCUGACGCCAGAACAGGUAGUG

GCAAUCGCCUCAAAUAAUGGUGGAAAACAGGCGUUAGAGACAGUCCAGCGCCUGCUGCCUGUAUUAUGUCAAGCCCAUGGCCU

GACCCCAGAGCAAGUUGUUGCGAUUGCAAGUAAUGGCGGGGUAAACAGGCACUUGAGACAGUUCAACGUUUACUGCCUGUAC

UGUGCCAAGCUCACGGUCUGACAUCCGAACAAGUCGUCGAUUGCGAGUCAUGAUGGUGGCAAACAAGCAUUAGAAACGGUG

CAACGCCUGCUGCCAGUUCUUUGCCAGGCUCACGGUUUAACCCCUGAGCAGGUUGUAGCUAUUGCGAGUAACAUUGGUGGUAA

GCAGGCGUUGGAAACUGUGCAAAGACUGCUGCCCGUGUUGUGCCAAGCACAUGGUUUAACCCCAGAACAAGUCGUAGCAAUCG

CAAGCAACAAUGGUGGCAAGCAAGCGCUUGAAACAGUACAGCGUUUAUUACCGGUACUUUGUCAGGCCCACGGUCUUACACCA

GAACAAGUUGGCCAUAGCCAGUCAUGACGCGGAAAGCAGGCUCUGGAAACGGUACAACGUCUGUUACCUGUUCUGUGUCA

AGCGCACGGAUUAACACCUGAACAAGUAGUUGCCAUUGCGUCACAUGAUGGAGGCAAGCAGGCCUUGGAGACAGUGCAGAGAU

UACUGCCAGUGUUGUGUCAGGCUCAUGGCCUUACACCCGAGCAGGUCGUGGCAAUUGCAUCUAAUAUCGGCGGUAAGCAAGCU

UUAGAGACUGUUCAGAGACUGCUUCCUGUCCUGUGCCAGGCACACGGACUUACGCCUGAGCAAGUGGUUGCAAUCGCCUCUAA

UAAUGGUGGUAAGCAAGCACUGGAAACUGUCCAACGCUUACUUCCGGUGCUUUGUCAAGCACACGGCUUAACGCCAGAGCAGG

UCGUCGCCAUAGCCAGCAAUAUAGGUGGUAAACAGGCCCUUGAAACGGUCCAAAGACUUCUGCCGGUCCUUUGCCAAGCGCAU

GGGCUGACACCUGAGCAGGUAGUCGCGAUUGCCUCAAACAUUGGUGGAAGCAGGCAUUAGAAACAGUUCAAAGAUUAUUACC

AGUCCUGUGUCAGGCGCAUGGGUUAACCCCAGAGCAGGUAGUUGCAAUAGCAUCCAAUAUCGGCGGAAAACAAGCGUUGGAAA
```

-continued

CGGUUCAGCGGUUAUUGCCUGUUUUGUGCCAGGCGCAUGGUUUGACACCCGAGCAAGUGGUAGCCAUAGCCUCACAUGAUGGG

GGUAAACAAGCUUUGGAGACAGUACAACGGCUGCUUCCAGUUUUAUGUCAGGCCCAUGGAUUGACGCCUGAACAAGUUGUCGC

UAUCGCAAGUCAUGACGGUGGUAAACAAGCGCUUGAAACCGUUCAACGCCUUCUGCCUGUGCUUUGUCAGGCACAUGGAUUAA

CACCCGAACAGGUUGUCGCGAUAGCUUCAAAUAUAGGUGGUCGUCCGGCACUGGAAAGCAUUGUUGCACAGCUGAGCCGUCCU

GAUCCGGCACUGGCAGCACUGACCAAUGAUCAUCUGGUUGCACUGGCAUGUCUGGGGUGGUCGCCCUGCCCUGGAUGCAGUUAA

AAAAGGUCUGCCGCAUGCACCGGCACUGAUUAAACGUACCAAUCGUCGUAUUCCGGAACGUACCAGCCAUCGUGUUGCUAGC

>TAL7-VPR protein

SEQ ID NO.: 202

MAPKKKRKVGIHGVPAAGSSGSHMVDLRTLGYSQQQQEKIKPKVRSTVAQHHEALVGHGFTHAHIVALSQHPAALGTVAVKYQ

DMIAALPEATHEAIVGVGKRGAGARALEALLTVAGELRGPPLQLDTGQLLKIAKRGGVTAVEAVHAWRNALTGAPLULTPEQV

VAIASHDGGKQALETVQRLLPVLCQAHGLTPEQVVAIASUGGGKQALETVQRLLPVLCQAHGLTPEQVVAIASUNGGKQALET

VQRLLPVLCQAHGLTPEQVVAIASNIGGKQALETVQRLLPVLCQAHGLTPEQVVAIASNIGGKQALETVQRLLPVLCQAHGLT

PEQVVAIASHDGGKQALETVQRLLPVLCQAHGLTPEQVVAIASNIGGKQALETVQRLLPVLCQAHGLTPEQVVAIASUGGGKQ

ALETVQRLLPVLCQAHGLTPEQVVAIASHDGGKQALETVQRLLPVLCQAHGLTPEQVVAIASUNGGKQALETVQRLLPVLCQA

HGLTPEQVVAIASUNGGKQALETVQRLLPVLCQAHGLTPEQVVAIASUGGGKQALETVQRLLPVLCQAHGLTPEQVVAIASNN

GGKQALETVQRLLPVLCQAHGLTPEQVVAIASNIGGKQALETVQRLLPVLCQAHGLTPEQVVAIASUNGGKQALETVQRLLPV

LCQAHGLTPEQVVAIASUGGGKQALETVQRLLPVLCQAHGLTPEQVVAIASUGGGKQALETVQRLLPVLCQAHGLTPEQVVAI

ASNIGGRPALESIVAQLSRPDPALAALTNDHLVALACLGGRPALDAVKKGLPHAPALIKRTURRIPERTSHRVASGSGGGSGG

DALDDFDLDMLGSDALDDFDLDMLGSDALDDFDLDMLGSDALDDFDLDMLSGGPKKKRKVGSQYLPDTDDRHRIEEKRKRTYE

TFKSIMKKSPFSGPTDPRPPPRRIAVPSRSSASVPKPAPQPYPFTSSLSTINYDEFPTMVFPSGQISQASALAPAPPQVLPQA

PAPAPAPAMVSALAQAPAPVPVLAPGPPQAVAPPAPKPTQAGEGTLSEALLQLQFDDEDLGALLGNSTDPAVFTDLASVDNSE

FQQLLNQGIPVAPHTTEPMLMEYPEAITRLVTGAQRPPDPAPAPLGAPGLPNGLLSGDEDFSSIADMDFSALLGSGSGSRDSR

EGMFLPKPEAGSAISDVFEGREVCQPKRLRPFHPPGSPWANRPLPASLAPTPTGPVHEPVGSLTPAPVPQPLDPAPAVTPEAS

HLLEDPDEETSQAVKALREMADTVIPQKEEAAICGQMDLSHPPPRGHLDELTTTLESMTEDLNLDSPLTPELNEILDTFLNDE

CLLHAMHISTGLSIFDTSLFSGGKRPAATKKAGQAKKKKGSYPYDVPDYA*

>TAL7-VPR mRNA

SEQ ID NO.: 203

AGGAAATAAGAGAGAAAAGAAGAGTAAGAAGAAATATAAGAGCCACCATGGCCCCCAAGAAGAAGCGGAAGGTGGGCATCCAC

GGCGTGCCCGCCGCCGGCAGCAGCGGATCCCATATGGTTGATCTGCGTACCCTGGGTTATAGCCAGCAGCAGCAAGAAAAAT

CAAACCGAAAGTTCGTAGCACCGTTGCACAGCATCATGAAGCACTGGTTGGTCATGGTTTTACCCATGCACATATTGTTGCAC

TGAGCCAGCATCCGGCAGCACTGGGCACCGTTGCAGTTAAATATCAGGATATGATTGCAGCACTGCCGGAAGCAACCCATGAA

GCAATTGTTGGTGTTGGTAAACGCGGAGCTGGTGCACGTGCCCTGGAAGCACTGCTGACCGTTGCCGGTGAACTGCGTGGTCC

GCCTCTGCAGCTGGATACCGGTCAGCTGCTGAAAATTGCAAAACGTGGTGGTGTTACCGCAGTTGAAGCAGTTCATGCATGGC

GTAATGCACTGACCGGTGCACCGCTGAATCTGACACCGGAACAGGTTGTTGCAATTGCCAGCCATGATGGTGGCAAACAGGCA

CTGGAAACCGTTCAGCGTCTGCTGCCGGTTCTGTGTCAGGCACATGGTCTGACCCCTGAACAGGTGGTGGCCATTGCAAGCAA

TGGTGGCGGTAAACAAGCCCTGGAAACAGTGCAGCGCCTGTTACCGGTGCTGTGCCAGGCCCATGGCTTAACTCCGGAACAGG

TGGTAGCGATCGCATCAAATAATGGAGGTAAACAGGCCTTAGAAACCGTACAGCGCTTACTGCCGGTGTTATGCCAGGCGCAC

GGCCTGACGCCAGAACAGGTAGTGGCAATCGCCTCAAACATTGGTGGAAAACAGGCGTTAGAGACAGTCCAGCGCCTGCTGCC

TGTATTATGTCAAGCCCATGGCCTGACCCCAGAGCAAGTTGTTGCGATTGCAAGTAATATCGGGGGTAAACAGGCACTTGAGA

CAGTTCAACGTTTACTGCCTGTACTGTGCCAAGCTCACGGTCTGACTCCGGAACAAGTCGTCGCGATTGCGAGTCATGACGGT

GGCAAACAAGCATTAGAAACGGTGCAACGCCTGCTGCCAGTTCTTTGCCAGGCTCACGGTTTAACCCCTGAGCAGGTTGTAGC

TATTGCGAGTAATATAGGTGGTAAGCAGGCGTTGGAAACTGTGCAAAGACTGCTGCCCGTGTTGTGCCAAGCACATGGTTTAA

CCCCAGAACAAGTCGTAGCAATCGCAAGCAATGGCGGTGGCAAGCAAGCGCTTGAAACAGTACAGCGTTTATTACCGGTACTT

-continued

```
TGTCAGGCCCACGGTCTTACACCAGAACAAGTTGTGGCCATAGCCAGTCATGATGGCGGAAAGCAGGCTCTGGAAACGGTACA

ACGTCTGTTACCTGTTCTGTGTCAAGCGCACGGATTAACACCTGAACAAGTAGTTGCCATTGCGTCAAATAATGGAGGCAAGC

AGGCCTTGGAGACAGTGCAGAGATTACTGCCAGTGTTGTGTCAGGCTCATGGCCTTACACCCGAGCAGGTCGTGGCAATTGCA

TCTAACAATGGCGGTAAGCAAGCTTTAGAGACTGTTCAGAGACTGCTTCCTGTCCTGTGCCAGGCACACGGACTTACGCCTGA

GCAAGTGGTTGCAATCGCCTCTAATGGGGGTGGTAAGCAAGCACTGGAAACTGTCCAACGCTTACTTCCGGTGCTTTGTCAAG

CACACGGCTTAACGCCAGAGCAGGTCGTCGCCATAGCCAGCAATAATGGTGGTAAACAGGCCCTTGAAACGGTCCAAAGACTT

CTGCCGGTCCTTTGCCAAGCGCATGGGCTGACACCTGAGCAGGTAGTCGCGATTGCCTCAAACATTGGTGGGAAGCAGGCATT

AGAAACAGTTCAAAGATTATTACCAGTCCTGTGTCAGGCGCATGGGTTAACCCCAGAGCAGGTAGTTGCAATAGCATCCAACA

ATGGCGGAAAACAAGCGTTGGAAACGGTTCAGCGGTTATTGCCTGTTTTGTGCCAGGCGCATGGTTTGACACCCGAGCAAGTG

GTAGCCATAGCCTCAAACGGTGGGGGTAAACAAGCTTTGGAGACAGTACAACGGCTGCTTCCAGTTTTATGTCAGGCCCATGG

ATTGACGCCTGAACAAGTTGTCGCTATCGCAAGTAATGGTGGTGGTAAACAAGCGCTTGAAACCGTTCAACGCCTTCTGCCTG

TGCTTTGTCAGGCACATGGATTAACACCCGAACAGGTTGTCGCGATAGCTTCAAATATCGGTGGTCGTCCGGCACTGGAAAGC

ATTGTTGCACAGCTGAGCCGTCCTGATCCGGCACTGGCAGCACTGACCAATGATCATCTGGTTGCACTGGCATGTCTGGGTGG

TCGCCCTGCCCTGGATGCAGTTAAAAAAGGTCTGCCGCATGCACCGGCACTGATTAAACGTACCAATCGTCGTATTCCGGAAC

GTACCAGCCATCGTGTTGCTAGCGGCAGCGGCGGCGGCAGCGGCGGCGACGCCCTGGACGACTTCGACCTGGACATGCTGGGC

AGCGACGCCCTGGACGACTTCGACCTGGACATGCTGGGCAGCGACGCCCTGGACGACTTCGACCTGGACATGCTGGGCAGCGA

CGCCCTGGACGACTTCGACCTGGACATGCTGAGCGGCGGCCCCAAGAAGAAGCGGAAGGTGGGCAGCCAGTACCTGCCCGACA

CCGACGACCGGCACCGGATCGAGGAGAAGCGGAAGCGGACCTACGAGACCTTCAAGAGCATCATGAAGAAATCCCCCTTCAGC

GGCCCCACCGACCCCCGGCCCCCCCCCGGCGGATCGCCGTGCCCAGCCGGAGCAGCGCCAGCGTGCCCAAGCCCGCCCCCCA

GCCCTACCCCTTCACCAGCAGCCTGAGCACCATCAACTACGACGAGTTCCCCACCATGGTGTTCCCCAGCGGCCAGATCAGCC

AGGCCAGCGCCCTGGCCCCCGCCCCCCCCAGGTGCTGCCCCAGGCCCCCGCCCCGCCCCCGCCCCGCCATGGTGAGCGCC

CTGGCCCAGGCCCCGCCCCCGTGCCGTGCTGGCCCCGGCCCCCCCAGGCCGTGGCCCCCCCGCCCCAAGCCCACCCA

GGCCGGCGAGGGCACCCTGAGCGAGGCCCTGCTGCAGCTGCAGTTCGACGACGAGGACCTGGGCGCCCTGCTGGGCAACAGCA

CCGACCCCGCCGTGTTCACCGACCTGGCCAGCGTGGACAACAGCGAGTTCCAGCAGCTGCTGAACCAGGGCATCCCCGTGGCC

CCCCACACCACCGAGCCCATGCTGATGGAGTACCCCGAGGCCATCACCCGGCTGGTGACCGGCGCCCAGCGGCCCCCCGACCC

CGCCCCCGCCCCCCCTGGGCGCCCCCGGCCTGCCCAACGGCCTGCTGAGCGGCGACGAGGACTTCAGCAGCATCGCCGACATGG

ACTTCAGCGCCCTGCTGGGCAGCGGCAGCGGCAGCCGGGACAGCGGGAGGGCATGTTCCTGCCCAAGCCCGAGGCCGGCAGC

GCCATCAGCGACGTGTTCGAGGGCCGGGAGGTGTGCCAGCCCAAGCGGCTCCGGCCCTTCCACCCCCCGGCAGCCCCTGGGC

CAACCGGCCCCTGCCCGCCAGCCTGGCCCCCACCCCCACCGGCCCCGTGCACGAGCCCGTGGGCAGCCTGACCCCCGCCCCCG

TGCCCCAGCCCCTGGACCCCGCCCCGCCGTGACCCCCGAGGCCAGCCACCTGCTGGAGGACCCCGACGAGGAGACCAGCCAG

GCCGTGAAGGCCCTGCGGGAGATGGCCGACACCGTGATCCCCCAGAAGGAGGAGGCCGCCATCTGCGGCCAGATGGACCTGAG

CCACCCCCCCCCCGGGGCCACCTGGACGAGCTGACCACCACCCTGGAGAGCATGACCGAGGACCTGAACCTGGACAGCCCCC

TGACCCCCGAGCTGAACGAGATCCTGGACACCTTCCTGAACGACGAGTGCCTGCTGCACGCCATGCACATCAGCACCGGCCTG

AGCATCTTCGACACCAGCCTGTTCAGCGGCGGCAAGCGGCCCGCCGCCACCAAGAAGGCCGGCCAGGCCAAGAAGAAGGGG

CAGCTACCCCTACGACGTGCCCGACTACGCCTGAGCGGCCGCTTAATTAAGCTGCCTTCTGCGGGGCTTGCCTTCTGGCCATG

CCCTTCTTCTCTCCCTTGCACCTGTACCTCTTGGTCTTTGAATAAAGCCTGAGTAGGAAGTCTAGAAAAAAAAAAAAAAAAA

AAAAAAAAAAAAAAAAAAAAAAAAAAAAAAAAAAAAAAAAAAAAAAAAAAAAA
```

>TAL7 amino acid sequence
SEQ ID NO.: 204

GSHMVDLRTLGYSQQQQEKIKPKVRSTVAQHHEALVGHGFTHAHIVALSQHPAALGTVAVKYQDMIAALPEATHEAIVGVKR

GAGARALEALLTVAGELRGPPLQLDTGQLLKIAKRGGVTAVEAVHAWRNALTGAPLNLTPEQVVAIASHDGGKQALETVQRLL

-continued

PVLCQAHGLTPEQVVAIASNGGGKQALETVQRLLPVLCQAHGLTPEQVVAIASNNGGKQALETVQRLLPVLCQAHGLTPEQVV

AIASNIGGKQALETVQRLLPVLCQAHGLTPEQVVAIASNIGGKQALETVQRLLPVLCQAHGLTPEQVVAIASHDGGKQALETV

QRLLPVLCQAHGLTPEQVVAIASNIGGKQALETVQRLLPVLCQAHGLTPEQVVAIASNGGGKQALETVQRLLPVLCQAHGLTP

EQVVAIASHDGGKQALETVQRLLPVLCQAHGLTPEQVVAIASNNGGKQALETVQRLLPVLCQAHGLTPEQVVAIASNNGGKQA

LETVQRLLPVLCQAHGLTPEQVVAIASNGGGKQALETVQRLLPVLCQAHGLTPEQVVAIASNNGGKQALETVQRLLPVLCQAH

GLTPEQVVAIASNIGGKQALETVQRLLPVLCQAHGLTPEQVVAIASNNGGKQALETVQRLLPVLCQAHGLTPEQVVAIASNGG

GKQALETVQRLLPVLCQAHGLTPEQVVAIASNGGGKQALETVQRLLPVLCQAHGLTPEQVVAIASNIGGRPALESIVAQLSRP

DPALAALTNDHLVALACLGGRPALDAVKKGLPHAPALIKRTNRRIPERTSHRVAS

>TAL7 mRNA sequence
SEQ ID NO.: 250

GGAUCCCAUAUGGUUGAUCUGCGUACCCUGGGUUAUAGCCAGCAGCAGCAAGAAAAAAUCAAACCGAAAGUUCGUAGCACCGU

UGCACAGCAUCAUGAAGCACUGGUUGGUCAUGGUUUUUACCCAUGCACAUAUUGUUGCACUGAGCCAGCAUCCGGCAGCACUGG

GCACCGUUGCAGUUAAAUAUCAGGAUAUGAUUGCAGCACUGCCGGAAGCAACCCAUGAAGCAAUUGUUGGUGUUGGUAAACGC

GGAGCUGGUGCACGUGCCCUGGAAGCACUGCUGACCGUUGCCGGUGAACUGCGUGGUCCGCCUCUGCAGCUGGAUACCGGUCA

GCUGCUGAAAAUUGCAAAACGUGGUGGUGUUACCGCAGUUGAAGCAGUUCAUGCAUGGCGUAAUGCACUGACCGGUGCACCGC

UGAAUCUGACACCGGAACAGGUUGUUGCAAUUGCCAGCCAUGAUGGUGGCAAACAGGCACUGGAAACCGUUCAGCGUCUGCUG

CCGGUUCUGUGUCAGGCACAUGGUCUGACCCCUGAACAGGUGGUGGCCAUUGCAAGCAAUGGUGGCGGUAAACAAGCCCUGGA

AACAGUGCAGCGCCUGUUACCGGUGCUGUGCCAGGCCCAUGGCUUAACUCCGGAACAGGUGGUAGCGAUCGCAUCAAAUAAUG

GAGGUAAACAGGCCUUAGAAACCGUACAGCGCUUACUGCCGGUGUUAUGCCAGGCGCACGGCCUGACGCCAGAACAGGUAGUG

GCAAUCGCCUCAAACAUUGGUGGAAAACAGGCGUUAGAGACAGUCCAGCGCCUGCUGCCUGUAUUAUGUCAAGCCCAUGGCCU

GACCCCAGAGCAAGUUGUUGCGAUUGCAAGUAAUAUCGGGGGUAAACAGGCACUUGAGACAGUUCAACGUUUACUGCCUGUAC

UGUGCCAAGCUCACGGUCUGACUCCGAACAAGUCGUCGCGAUUGCGAGUCAUGACGGUGGCAAACAAGCAUUAGAAACGGUG

CAACGCCUGCUGCCAGUUCUUUGCCAGGCUCACGGUUUAACCCCUGAGCAGGUUGUAGCUAUUGCGAGUAAUAUAGGUGGUAA

GCAGGCGUUGGAAACUGUGCAAAGACUGCUGCCCGUGUUGUGCCAAGCACAUGGUUUAACCCCAGAACAAGUCGUAGCAAUCG

CAAGCAAUGGCGGUGGCAAGCAAGCGCUUGAAACAGUACAGCGUUUAUUACCGGUACUUUGUCAGGCCCACGGUCUUACACCA

GAACAAGUUGUGGCCAUAGCCAGUCAUGAUGGCGGAAAGCAGGCUCUGGAAACGGUACAACGUCUGUUACCUGUUCUGUGUCA

AGCGCACGGAUUAACACCUGAACAAGUAGUUGCCAUUGCGUCAAAUAAUGGAGGCAAGCAGGCCUUGGAGACAGUGCAGAGAU

UACUGCCAGUGUUGUGUCAGGCUCAUGGCCUUACACCCGAGCAGGUCGUGGCAAUUGCAUCUAACAAUGGCGGUAAGCAAGCU

UUAGAGACUGUUCAGAGACUGCUUCCUGUCCUGUGCCAGGCACACGGACUUACGCCUGAGCAAGUGGUUGCAAUCGCCUCUAA

UGGGGGUGGUAAGCAAGCACUGGAAACUGUCCAACGCUUACUUCCGGUGCUUUGUCAAGCACACGGCUUAACGCCAGAGCAGG

UCGUCGCCAUAGCCAGCAAUAAUGGUGGUAAACAGGCCCUUGAAACGGUCCAAAGACUUCUGCCGGUCCUUUGCCAAGCGCAU

GGGCUGACACCUGAGCAGGUAGUCGCGAUUGCCUCAAACAUUGGUGGGAAGCAGGCAUUAGAAACAGUUCAAAGAUUAUUACC

AGUCCUGUGUCAGGCGCAUGGGUUAACCCCAGAGCAGGUAGUUGCAAUAGCAUCCAACAAUGGCGGAAAACAAGCGUUGGAAA

CGGUUCAGCGGUUAUUGCCUGUUUUGUGCCAGGCGCAUGGUUUGACACCCGAGCAAGUGGUAGCCAUAGCCUCAAACGGUGGG

GGUAAACAAGCUUUGGAGACAGUACAACGGCUGCUUCCAGUUUUAUGUCAGGCCCAUGGAUUGACGCCUGAACAAGUUGUCGC

UAUCGCAAGUAAUGGUGGUGGUAAACAAGCGCUUGAAACCGUUCAACGCCUUCUGCCUGUGCUUUGUCAGGCACAUGGAUUAA

CACCCGAACAGGUUGUCGCGAUAGCUUCAAAUAUCGGUGGUCGUCCGGCACUGGAAAGCAUUGUUGCACAGCUGAGCCGUCCU

GAUCCGGCACUGGCAGCACUGACCAAUGAUCAUCUGGUUGCACUGGCAUGUCUGGGUGGUCGCCCUGCCCUGGAUGCAGUUAA

AAAAGGUCUGCCGCAUGCACCGGCACUGAUUAAACGUACCAAUCGUCGUAUUCCGGAACGUACCAGCCAUCGUGUUGCUAGC

>TAL8-VPR protein
SEQ ID NO.: 205

MAPKKKRKVGIHGVPAAGSSGSHMVDLRTLGYSQQQQEKIKPKVRSTVAQHHEALVGHGFTHAHIVALSQHPAALGTVAVKYQ

DMIAALPEATHEAIVGVGKRGAGARALEALLTVAGELRGPPLQLDTGQLLKIAKRGGVTAVEAVHAWRNALTGAPLULTPEQV

VAIASHDGGKQALETVQRLLPVLCQAHGLTPEQVVAIASUGGGKQALETVQRLLPVLCQAHGLTPEQVVAIASUGGGKQALET
VQRLLPVLCQAHGLTPEQVVAIASUNGGKQALETVQRLLPVLCQAHGLTPEQVVAIASUNGGKQALETVQRLLPVLCQAHGLT
PEQVVAIASUNGGKQALETVQRLLPVLCQAHGLTPEQVVAIASUNGGKQALETVQRLLPVLCQAHGLTPEQVVAIASNGGGKQ
ALETVQRLLPVLCQAHGLTPEQVVAIASUNGGKQALETVQRLLPVLCQAHGLTPEQVVAIASNIGGKQALETVQRLLPVLCQA
HGLTPEQVVAIASHDGGKQALETVQRLLPVLCQAHGLTPEQVVAIASNIGGKQALETVQRLLPVLCQAHGLTPEQVVAIASNI
GGKQALETVQRLLPVLCQAHGLTPEQVVAIASUGGGKQALETVQRLLPVLCQAHGLTPEQVVAIASUNGGKQALETVQRLLPV
LCQAHGLTPEQVVAIASUNGGKQALETVQRLLPVLCQAHGLTPEQVVAIASHDGGKQALETVQRLLPVLCQAHGLTPEQVVAI
ASUGGGRPALESIVAQLSRPDPALAALTNDHLVALACLGGRPALDAVKKGLPHAPALIKRTURRIPERTSHRVASGSGGGSGG
DALDDFDLDMLGSDALDDFDLDMLGSDALDDFDLDMLGSDALDDFDLDMLSGGPKKKRKVGSQYLPDTDDRHRIEEKRKRTYE
TFKSIMKKSPFSGPTDPRPPPRRIAVPSRSSASVPKPAPQPYPFTSSLSTINYDEFPTMVFPSGQISQASALAPAPPQVLPQA
PAPAPAPAMVSALAQAPAPVPVLAPGPPQAVAPPAPKPTQAGEGTLSEALLQLQFDDEDLGALLGNSTDPAVFTDLASVDNSE
FQQLLNQGIPVAPHTTEPMLMEYPEAITRLVTGAQRPPDPAPAPLGAPGLPNGLLSGDEDFSSIADMDFSALLGSGSGSRDSR
EGMFLPKPEAGSAISDVFEGREVCQPKRLRPFHPPGSPWANRPLPASLAPTPTGPVHEPVGSLTPAPVPQPLDPAPAVTPEAS
HLLEDPDEETSQAVKALREMADTVIPQKEEAAICGQMDLSHPPPRGHLDELTTTLESMTEDLNLDSPLTPELNEILDTFLNDE
CLLHAMHISTGLSIFDTSLFSGGKRPAATKKAGQAKKKKGSYPYDVPDYA*

>TAL8-VPR mRNA

SEQ ID NO.: 206

AGGAAATAAGAGAGAAAAGAAGAGTAAGAAGAAATATAAGAGCCACCATGGCCCCCAAGAAGAAGCGGAAGGTGGGCATCCAC
GGCGTGCCCGCCGCCGGCAGCAGCGGATCCCATATGGTTGATCTGCGTACCCTGGGTTATAGCCAGCAGCAGCAAGAAAAAAT
CAAACCGAAAGTTCGTAGCACCGTTGCACAGCATCATGAAGCACTGGTTGGTCATGGTTTTACCCATGCACATATTGTTGCAC
TGAGCCAGCATCCGGCAGCACTGGGCACCGTTGCAGTTAAATATCAGGATATGATTGCAGCACTGCCGGAAGCAACCCATGAA
GCAATTGTTGGTGTTGGTAAACGCGGAGCTGGTGCACGTGCCCTGGAAGCACTGCTGACCGTTGCCGGTGAACTGCGTGGTCC
GCCTCTGCAGCTGGATACCGGTCAGCTGCTGAAAATTGCAAAACGTGGTGGTGTTACCGCAGTTGAAGCAGTTCATGCATGGC
GTAATGCACTGACCGGTGCACCGCTGAATCTGACACCGGAACAGGTTGTTGCAATTGCCAGCCATGATGGTGGCAAACAGGCA
CTGGAAACCGTTCAGCGTCTGCTGCCGGTTCTGTGTCAGGCACATGGTCTGACCCCTGAACAGGTGGTGGCCATTGCAAGCAA
TGGTGGCGGTAAACAAGCCCTGGAAACAGTGCAGCGCCTGTTACCGGTGCTGTGCCAGGCCCATGGCTTAACTCCGGAACAGG
TGGTAGCGATCGCATCAAATGGCGGAGGTAAACAGGCCTTAGAAACCGTACAGCGCTTACTGCCGGTGTTATGCCAGGCGCAC
GGCCTGACGCCAGAACAGGTAGTGGCAATCGCCTCAAATAATGGTGGAAAACAGGCGTTAGAGACAGTCCAGCGCCTGCTGCC
TGTATTATGTCAAGCCCATGGCCTGACCCCAGAGCAAGTTGTTGCGATTGCAAGTAACAATGGGGGTAAACAGGCACTTGAGA
CAGTTCAACGTTTACTGCCTGTACTGTGCCAAGCTCACGGTCTGACTCCGGAACAAGTCGTCGCGATTGCGAGTAATAATGGT
GGCAAACAAGCATTAGAAACGGTGCAACGCCTGCTGCCAGTTCTTTGCCAGGCTCACGGTTTAACCCCTGAGCAGGTTGTAGC
TATTGCGAGTAACAATGGTGGTAAGCAGGCGTTGGAAACTGTGCAAAGACTGCTGCCCGTGTTGTGCCAAGCACATGGTTTAA
CCCCAGAACAAGTCGTAGCAATCGCAAGCAATGGGGGTGGCAAGCAAGCGCTTGAAACAGTACAGCGTTTATTACCGGTACTT
TGTCAGGCCCACGGTCTTACACCAGAACAAGTTGTGGCCATAGCCAGTAATAATGGCGGAAAGCAGGCTCTGGAAACGGTACA
ACGTCTGTTACCTGTTCTGTGTCAAGCGCACGGATTAACACCTGAACAAGTAGTTGCCATTGCGTCAAACATTGGAGGCAAGC
AGGCCTTGGAGACAGTGCAGAGATTACTGCCAGTGTTGTGTCAGGCTCATGGCCTTACACCCGAGCAGGTCGTGGCAATTGCA
TCTCATGACGGCGGTAAGCAAGCTTTAGAGACTGTTCAGAGACTGCTTCCTGTCCTGTGCCAGGCACACGGACTTACGCCTGA
GCAAGTGGTTGCAATCGCCTCTAATATCGGTGGTAAGCAAGCACTGGAAACTGTCCAACGCTTACTTCCGGTGCTTTGTCAAG
CACACGGCTTAACGCCAGAGCAGGTCGTCGCCATAGCCAGCAATATAGGTGGTAAACAGGCCCTTGAAACGGTCCAAAGACTT
CTGCCGGTCCTTTGCCAAGCGCATGGGCTGACACCTGAGCAGGTAGTCGCGATTGCCTCAAACGGTGGTGGGAAGCAGGCATT
AGAAACAGTTCAAAGATTATTACCAGTCCTGTGTCAGGCGCATGGGTTAACCCCAGAGCAGGTAGTTGCAATAGCATCCAACA

```
ATGGCGGAAAACAAGCGTTGGAAACGGTTCAGCGGTTATTGCCTGTTTTGTGCCAGGCGCATGGTTTGACACCCGAGCAAGTG

GTAGCCATAGCCTCAAATAATGGGGGTAAACAAGCTTTGGAGACAGTACAACGGCTGCTTCCAGTTTTATGTCAGGCCCATGG

ATTGACGCCTGAACAAGTTGTCGCTATCGCAAGTCATGATGGTGGTAAACAAGCGCTTGAAACCGTTCAACGCCTTCTGCCTG

TGCTTTGTCAGGCACATGGATTAACACCCGAACAGGTTGTCGCGATAGCTTCAAATGGTGGTGGTCGTCCGGCACTGGAAAGC

ATTGTTGCACAGCTGAGCCGTCCTGATCCGGCACTGGCAGCACTGACCAATGATCATCTGGTTGCACTGGCATGTCTGGGTGG

TCGCCCTGCCCTGGATGCAGTTAAAAAAGGTCTGCCGCATGCACCGGCACTGATTAAACGTACCAATCGTCGTATTCCGGAAC

GTACCAGCCATCGTGTTGCTAGCGGCAGCGGCGGCGGCAGCGGCGGCGACGCCCTGGACGACTTCGACCTGGACATGCTGGGC

AGCGACGCCCTGGACGACTTCGACCTGGACATGCTGGGCAGCGACGCCCTGGACGACTTCGACCTGGACATGCTGGGCAGCGA

CGCCCTGGACGACTTCGACCTGGACATGCTGAGCGGCGGCCCCAAGAAGAAGCGGAAGGTGGGCAGCCAGTACCTGCCCGACA

CCGACGACCGGCACCGGATCGAGGAGAAGCGGAAGCGGACCTACGAGACCTTCAAGAGCATCATGAAGAAATCCCCCTTCAGC

GGCCCCACCGACCCCCGGCCCCCCCCCGGCGGATCGCCGTGCCCAGCCGGAGCAGCGCCAGCGTGCCCAAGCCCGCCCCCCA

GCCCTACCCCTTCACCAGCAGCCTGAGCACCATCAACTACGACGAGTTCCCCACCATGGTGTTCCCCAGCGGCCAGATCAGCC

AGGCCAGCGCCCTGGCCCCCGCCCCCCCCAGGTGCTGCCCCAGGCCCCCGCCCCCGCCCCCGCCCCCGCCATGGTGAGCGCC

CTGGCCCAGGCCCCCGCCCCCGTGCCCGTGCTGGCCCCCGGCCCCCCCCAGGCCGTGGCCCCCCCCGCCCCCAAGCCCACCCA

GGCCGGCGAGGGCACCCTGAGCGAGGCCCTGCTGCAGCTGCAGTTCGACGACGAGGACCTGGGCGCCCTGCTGGGCAACAGCA

CCGACCCCGCCGTGTTCACCGACCTGGCCAGCGTGGACAACAGCGAGTTCCAGCAGCTGCTGAACCAGGGCATCCCCGTGGCC

CCCCACACCACCGAGCCCATGCTGATGGAGTACCCCGAGGCCATCACCCGGCTGGTGACCGGCGCCCAGCGGCCCCCCGACCC

CGCCCCCGCCCCCCTGGGCGCCCCCGGCCTGCCCAACGGCCTGCTGAGCGGCGACGAGGACTTCAGCAGCATCGCCGACATGG

ACTTCAGCGCCCTGCTGGGCAGCGGCAGCGGCAGCCGGGACAGCCGGGAGGGCATGTTCCTGCCCAAGCCCGAGGCCGGCAGC

GCCATCAGCGACGTGTTCGAGGGCCGGGAGGTGTGCCAGCCCAAGCGGCTCCGGCCCTTCCACCCCCCCGGCAGCCCCTGGGC

CAACCGGCCCCTGCCCGCCAGCCTGGCCCCCACCCCCACCGGCCCCGTGCACGAGCCCGTGGGCAGCCTGACCCCCGCCCCCG

TGCCCCAGCCCCTGGACCCCGCCCCCGCCGTGACCCCCGAGGCCAGCCACCTGCTGGAGGACCCCGACGAGGAGACCAGCCAG

GCCGTGAAGGCCCTGCGGGAGATGGCCGACACCGTGATCCCCCAGAAGGAGGAGGCCGCCATCTGCGGCCAGATGGACCTGAG

CCACCCCCCCCCCCGGGGCCACCTGGACGAGCTGACCACCACCCTGGAGAGCATGACCGAGGACCTGAACCTGGACAGCCCCC

TGACCCCCGAGCTGAACGAGATCCTGGACACCTTCCTGAACGACGAGTGCCTGCTGCACGCCATGCACATCAGCACCGGCCTG

AGCATCTTCGACACCAGCCTGTTCAGCGGCGGCAAGCGGCCCGCCGCCACCAAGAAGGCCGGCCAGGCCAAGAAGAAGAAGGG

CAGCTACCCCTACGACGTGCCCGACTACGCCTGAGCGGCCGCTTAATTAAGCTGCCTTCTGCGGGGCTTGCCTTCTGGCCATG

CCCTTCTTCTCTCCCTTGCACCTGTACCTCTTGGTCTTTGAATAAAGCCTGAGTAGGAAGTCTAGAAAAAAAAAAAAAAAAAA

AAAAAAAAAAAAAAAAAAAAAAAAAAAAAAAAAAAAAAAAAAAAAAAAAAAAA
```

>TAL8 amino acid sequence

SEQ ID NO.: 207

GSHMVDLRTLGYSQQQQEKIKPKVRSTVAQHHEALVGHGFTHAHIVALSQHPAALGTVAVKYQDMIAALPEATHEAIVGVGKR

GAGARALEALLTVAGELRGPPLQLDTGQLLKIAKRGGVTAVEAVHAWRNALTGAPLULTPEQVVAIASHDGGKQALETVQRLL

PVLCQAHGLTPEQVVAIASUGGGKQALETVQRLLPVLCQAHGLTPEQVVAIASUGGGKQALETVQRLLPVLCQAHGLTPEQVV

AIASUNGGKQALETVQRLLPVLCQAHGLTPEQVVAIASUNGGKQALETVQRLLPVLCQAHGLTPEQVVAIASNNGGKQALETV

QRLLPVLCQAHGLTPEQVVAIASUNGGKQALETVQRLLPVLCQAHGLTPEQVVAIASUGGGKQALETVQRLLPVLCQAHGLTP

EQVVAIASUNGGKQALETVQRLLPVLCQAHGLTPEQVVAIASNIGGKQALETVQRLLPVLCQAHGLTPEQVVAIASHDGGKQA

LETVQRLLPVLCQAHGLTPEQVVAIASNIGGKQALETVQRLLPVLCQAHGLTPEQVVAIASNIGGKQALETVQRLLPVLCQAH

GLTPEQVVAIASUGGGKQALETVQRLLPVLCQAHGLTPEQVVAIASUNGGKQALETVQRLLPVLCQAHGLTPEQVVAIASNNG

GKQALETVQRLLPVLCQAHGLTPEQVVAIASHDGGKQALETVQRLLPVLCQAHGLTPEQVVAIASUGGGRPALESIVAQLSRP

DPALAALTNDHLVALACLGGRPALDAVKKGLPHAPALIKRTURRIPERTSHRVAS

>TAL8 mRNA sequence

SEQ ID NO.: 251

GGAUCCCAUAUGGUUGAUCUGCGUACCCUGGGUUAUAGCCAGCAGCAGCAAGAAAAAAUCAAACCGAAAGUUCGUAGCACCGU

UGCACAGCAUCAUGAAGCACUGGUUGGUCAUGGUUUUACCCAUGCACAUAUUGUUGCACUGAGCCAGCAUCCGGCAGCACUGG

GCACCGUUGCAGUUAAAUAUCAGGAUAUGAUUGCAGCACUGCCGGAAGCAACCCAUGAAGCAAUUGUUGGUGUUGGUAAACGC

GGAGCUGGUGCACGUGCCCUGGAAGCACUGCUGACCGUUGCCGGUGAACUGCGUGGUCCGCCUCUGCAGCUGGAUACCGGUCA

GCUGCUGAAAAUUGCAAAACGUGGUGGUGUUACCGCAGUUGAAGCAGUUCAUGCAUGGCGUAAUGCACUGACCGGUGCACCGC

UGAAUCUGACACCGGAACAGGUUGUUGCAAUUGCCAGCCAUGAUGGUGGCAAACAGGCACUGGAAACCGUUCAGCGUCUGCUG

CCGGUUCUGUGUCAGGCACAUGGUCUGACCCCUGAACAGGUGGUGGCCAUUGCAAGCAAUGGUGGCGGUAAACAAGCCCUGGA

AACAGUGCAGCGCCUGUUACCGGUGCUGUGCCAGGCCCAUGGCUUAACUCCGGAACAGGUGGUAGCGAUCGCAUCAAAUGGCG

GAGGUAAACAGGCCUUAGAAACCGUACAGCGCUUACUGCCGGUGUUAUGCCAGGCGCACGGCCUGACGCCAGAACAGGUAGUG

GCAAUCGCCUCAAAUAAUGGUGGAAAACAGGCGUUAGAGACAGUCCAGCGCCUGCUGCCUGUAUUAUGUCAAGCCCAUGGCCU

GACCCCAGAGCAAGUUGUUGCGAUUGCAAGUAACAAUGGGGUAAACAGGCACUUGAGACAGUUCAACGUUUACUGCCUGUAC

UGUGCCAAGCUCACGGUCUGACUCCGGAACAAGUCGUCGCGAUUGCGAGUAAUAAUGGUGGCAAACAAGCAUUAGAAACGGUG

CAACGCCUGCUGCCAGUUCUUUGCCAGGCUCACGGUUUAACCCCUGAGCAGGUUGUAGCUAUUGCGAGUAACAAUGGUGGUAA

GCAGGCGUUGGAAACUGUGCAAAGACUGCUGCCCGUGUUGUGCCAAGCACAUGGUUUAACCCCAGAACAAGUCGUAGCAAUCG

CAAGCAAUGGGGGUGGCAAGCAAGCGCUUGAAACAGUACAGCGUUUAUUACCGGUACUUUGUCAGGCCCACGGUCUUACACCA

GAACAAGUUGUGGCCAUAGCCAGUAAUAAUGGCGGAAAGCAGGCUCUGGAAACGGUACAACGUCUGUUACCUGUUCUGUGUCA

AGCGCACGGAUUAACACCUGAACAAGUAGUUGCCAUUGCGUCAAACAUUGGAGGCAAGCAGGCCUUGGAGACAGUGCAGAGAU

UACUGCCAGUGUUGUGUCAGGCUCAUGGCCUUACACCCGAGCAGGUCGUGGCAAUUGCAUCUCAUGACGGCGGUAAGCAAGCU

UUAGAGACUGUUCAGAGACUGCUUCCUGUCCUGUGCCAGGCACACGGACUUACGCCUGAGCAAGUGGUUGCAAUCGCCUCUAA

UAUCGGUGGUAAGCAAGCACUGGAAACUGUCCAACGCUUACUUCCGGUGCUUUGUCAAGCACACGGCUUAACGCCAGAGCAGG

UCGUCGCCAUAGCCAGCAAUAUAGGUGGUAAACAGGCCCUUGAAACGGUCCAAAGACUUCUGCCGGUCCUUUGCCAAGCGCAU

GGGCUGACACCUGAGCAGGUAGUCGCGAUUGCCUCAAACGGUGGUGGGAAGCAGGCAUUAGAAACAGUUCAAAGAUUAUUACC

AGUCCUGUGUCAGGCGCAUGGGUUAACCCCAGAGCAGGUAGUUGCAAUAGCAUCCAACAAUGGCGGAAAACAAGCGUUGGAAA

CGGUUCAGCGGUUAUUGCCUGUUUUGUGCCAGGCGCAUGGUUUGACACCCGAGCAAGUGGUAGCCAUAGCCUCAAAUAAUGGG

GGUAAACAAGCUUUGGAGACAGUACAACGGCUGCUUCCAGUUUUAUGUCAGGCCCAUGGAUUGACGCCUGAACAAGUUGUCGC

UAUCGCAAGUCAUGAUGGUGGUAAACAAGCGCUUGAAACCGUUCAACGCCUUCUGCCUGUGCUUUGUCAGGCACAUGGAUUAA

CACCCGAACAGGUUGUCGCGAUAGCUUCAAAUGGUGGUGGUCGUCCGGCACUGGAAAGCAUUGUUGCACAGCUGAGCCGUCCU

GAUCCGGCACUGGCAGCACUGACCAAUGAUCAUCUGGUUGCACUGGCAUGUCUGGGUGGUCGCCCUGCCCUGGAUGCAGUUAA

AAAAGGUCUGCCGCAUGCACCGGCACUGAUUAAACGUACCAAUCGUCGUAUUCCGGAACGUACCAGCCAUCGUGUUGCUAGC

>TAL9-VPR protein

SEQ ID NO.: 208

MAPKKKRKVGIHGVPAAGSSGSHMVDLRTLGYSQQQQEKIKPKVRSTVAQHHEALVGHGFTHAHIVALSQHPAALGTVAVKYQ

DMIAALPEATHEAIVGVGKRGAGARALEALLTVAGELRGPPLQLDTGQLLKIAKRGGVTAVEAVHAWRNALTGAPLULTPEQV

VAIASUNGGKQALETVQRLLPVLCQAHGLTPEQVVAIASNIGGKQALETVQRLLPVLCQAHGLTPEQVVAIASNIGGKQALET

VQRLLPVLCQAHGLTPEQVVAIASUGGGKQALETVQRLLPVLCQAHGLTPEQVVAIASUGGGKQALETVQRLLPVLCQAHGLT

PEQVVAIASNIGGKQALETVQRLLPVLCQAHGLTPEQVVAIASUNGGKQALETVQRLLPVLCQAHGLTPEQVVAIASUNGGKQ

ALETVQRLLPVLCQAHGLTPEQVVAIASUNGGKQALETVQRLLPVLCQAHGLTPEQVVAIASUNGGKQALETVQRLLPVLCQA

HGLTPEQVVAIASNIGGKQALETVQRLLPVLCQAHGLTPEQVVAIASUGGGKQALETVQRLLPVLCQAHGLTPEQVVAIASHD

GGKQALETVQRLLPVLCQAHGLTPEQVVAIASUGGGKQALETVQRLLPVLCQAHGLTPEQVVAIASHDGGKQALETVQRLLPV

LCQAHGLTPEQVVAIASUNGGKQALETVQRLLPVLCQAHGLTPEQVVAIASUNGGKQALETVQRLLPVLCQAHGLTPEQVVAI

ASNIGGRPALESIVAQLSRPDPALAALTNDHLVALACLGGRPALDAVKKGLPHAPALIKRTURRIPERTSHRVASGSGGGSGG

DALDDFDLDMLGSDALDDFDLDMLGSDALDDFDLDMLGSDALDDFDLDMLSGGPKKKRKVGSQYLPDTDDRHRIEEKRKRTYE

TFKSIMKKSPFSGPTDPRPPPRRIAVPSRSSASVPKPAPQPYPFTSSLSTINYDEFPTMVFPSGQISQASALAPAPPQVLPQA

PAPAPAPAMVSALAQAPAPVPVLAPGPPQAVAPPAPKPTQAGEGTLSEALLQLQFDDEDLGALLGNSTDPAVFTDLASVDNSE

FQQLLNQGIPVAPHTTEPMLMEYPEAITRLVTGAQRPPDPAPAPLGAPGLPNGLLSGDEDFSSIADMDFSALLGSGSGSRDSR

EGMFLPKPEAGSAISDVFEGREVCQPKRLRPFHPPGSPWANRPLPASLAPTPTGPVHEPVGSLTPAPVPQPLDPAPAVTPEAS

HLLEDPDEETSQAVKALREMADTVIPQKEEAAICGQMDLSHPPPRGHLDELTTTLESMTEDLNLDSPLTPELNEILDTFLNDE

CLLHAMHISTGLSIFDTSLFSGGKRPAATKKAGQAKKKKGSYPYDVPDYA*

>TAL9-VPR mRNA

SEQ ID NO.: 209

AGGAAATAAGAGAGAAAAGAAGAGTAAGAAGAAATATAAGAGCCACCATGGCCCCCAAGAAGAAGCGGAAGGTGGGCATCCAC

GGCGTGCCCGCCGCCGGCAGCAGCGGATCCCATATGGTTGATCTGCGTACCCTGGGTTATAGCCAGCAGCAGCAAGAAAAAAT

CAAACCGAAAGTTCGTAGCACCGTTGCACAGCATCATGAAGCACTGGTTGGTCATGGTTTTACCCATGCACATATTGTTGCAC

TGAGCCAGCATCCGGCAGCACTGGGCACCGTTGCAGTTAAATATCAGGATATGATTGCAGCACTGCCGGAAGCAACCCATGAA

GCAATTGTTGGTGTTGGTAAACGCGGAGCTGGTGCACGTGCCCTGGAAGCACTGCTGACCGTTGCCGGTGAACTGCGTGGTCC

GCCTCTGCAGCTGGATACCGGTCAGCTGCTGAAAATTGCAAAACGTGGTGGTGTTACCGCAGTTGAAGCAGTTCATGCATGGC

GTAATGCACTGACCGGTGCACCGCTGAATCTGACACCGGAACAGGTTGTTGCAATTGCCAGCAATAATGGTGGCAAACAGGCA

CTGGAAACCGTTCAGCGTCTGCTGCCGGTTCTGTGTCAGGCACATGGTCTGACCCCTGAACAGGTGGTGGCCATTGCAAGCAA

CATTGGCGGTAAACAAGCCCTGGAAACAGTGCAGCGCCTGTTACCGGTGCTGTGCCAGGCCCATGGCTTAACTCCGGAACAGG

TGGTAGCGATCGCATCAAATATCGGAGGTAAACAGGCCTTAGAAACCGTACAGCGCTTACTGCCGGTGTTATGCCAGGCGCAC

GGCCTGACGCCAGAACAGGTAGTGGCAATCGCCTCAAATGGTGGTGGAAAACAGGCGTTAGAGACAGTCCAGCGCCTGCTGCC

TGTATTATGTCAAGCCCATGGCCTGACCCCAGAGCAAGTTGTTGCGATTGCAAGTAATGGCGGGGGTAAACAGGCACTTGAGA

CAGTTCAACGTTTACTGCCTGTACTGTGCCAAGCTCACGGTCTGACTCCGGAACAAGTCGTCGCGATTGCGAGTAATATAGGT

GGCAAACAAGCATTAGAAACGGTGCAACGCCTGCTGCCAGTTCTTTGCCAGGCTCACGGTTTAACCCCTGAGCAGGTTGTAGC

TATTGCGAGTAACAATGGTGGTAAGCAGGCGTTGGAAACTGTGCAAAGACTGCTGCCCGTGTTGTGCCAAGCACATGGTTTAA

CCCCAGAACAAGTCGTAGCAATCGCAAGCAATAATGGTGGCAAGCAAGCGCTTGAAACAGTACAGCGTTTATTACCGGTACTT

TGTCAGGCCCACGGTCTTACACCAGAACAAGTTGTGGCCATAGCCAGTAACAATGGCGGAAAGCAGGCTCTGGAAACGGTACA

ACGTCTGTTACCTGTTCTGTGTCAAGCGCACGGATTAACACCTGAACAAGTAGTTGCCATTGCGTCAAATAATGGAGGCAAGC

AGGCCTTGGAGACAGTGCAGAGATTACTGCCAGTGTTGTGTCAGGCTCATGGCCTTACACCCGAGCAGGTCGTGGCAATTGCA

TCTAACATTGGCGGTAAGCAAGCTTTAGAGACTGTTCAGAGACTGCTTCCTGTCCTGTGCCAGGCACACGGACTTACGCCTGA

GCAAGTGGTTGCAATCGCCTCTAATGGGGGTGGTAAGCAAGCACTGGAAACTGTCCAACGCTTACTTCCGGTGCTTTGTCAAG

CACACGGCTTAACGCCAGAGCAGGTCGTCGCCATAGCCAGCCATGATGGTGGTAAACAGGCCCTTGAAACGGTCCAAAGACTT

CTGCCGGTCCTTTGCCAAGCGCATGGGCTGACACCTGAGCAGGTAGTCGCGATTGCCTCAAACGGTGGTGGGAAGCAGGCATT

AGAAACAGTTCAAAGATTATTACCAGTCCTGTGTCAGGCGCATGGGTTAACCCCAGAGCAGGTAGTTGCAATAGCATCCCATG

ACGGCGGAAAACAAGCGTTGGAAACGGTTCAGCGGTTATTGCCTGTTTTGTGCCAGGCGCATGGTTTGACACCCGAGCAAGTG

GTAGCCATAGCCTCAAACAATGGGGGTAAACAAGCTTTGGAGACAGTACAACGGCTGCTTCCAGTTTTATGTCAGGCCCATGG

ATTGACGCCTGAACAAGTTGTCGCTATCGCAAGTAATAATGGTGGTAAACAAGCGCTTGAAACCGTTCAACGCCTTCTGCCTG

TGCTTTGTCAGGCACATGGATTAACACCCGAACAGGTTGTCGCGATAGCTTCAAATATCGGTGGTCGTCCGGCACTGGAAAGC

ATTGTTGCACAGCTGAGCCGTCCTGATCCGGCACTGGCAGCACTGACCAATGATCATCTGGTTGCACTGGCATGTCTGGGTGG

TCGCCCTGCCCTGGATGCAGTTAAAAAAGGTCTGCCGCATGCACCGGCACTGATTAAACGTACCAATCGTCGTATTCCGGAAC

GTACCAGCCATCGTGTTGCTAGCGGCAGCGGCGGCGGCAGCGGCGGCGACGCCCTGGACGACTTCGACCTGGACATGCTGGGC

AGCGACGCCCTGGACGACTTCGACCTGGACATGCTGGGCAGCGACGCCCTGGACGACTTCGACCTGGACATGCTGGGCAGCGA

-continued

```
CGCCCTGGACGACTTCGACCTGGACATGCTGAGCGGCGGCCCCAAGAAGAAGCGGAAGGTGGGCAGCCAGTACCTGCCCGACA

CCGACGACCGGCACCGGATCGAGGAGAAGCGGAAGCGGACCTACGAGACCTTCAAGAGCATCATGAAGAAATCCCCCTTCAGC

GGCCCCACCGACCCCCGGCCCCCCCCCGGCGGATCGCCGTGCCCAGCCGGAGCAGCGCCAGCGTGCCCAAGCCCGCCCCCCA

GCCCTACCCCTTCACCAGCAGCCTGAGCACCATCAACTACGACGAGTTCCCCACCATGGTGTTCCCCAGCGGCCAGATCAGCC

AGGCCAGCGCCCTGGCCCCCGCCCCCCCCCAGGTGCTGCCCCAGGCCCCCGCCCCCGCCCCCGCCCCCGCCATGGTGAGCGCC

CTGGCCCAGGCCCCCGCCCCCGTGCCCGTGCTGGCCCCCGGCCCCCCCCAGGCCGTGGCCCCCCCCGCCCCCAAGCCCACCCA

GGCCGGCGAGGGCACCCTGAGCGAGGCCCTGCTGCAGCTGCAGTTCGACGACGAGGACCTGGGCGCCCTGCTGGGCAACAGCA

CCGACCCCGCCGTGTTCACCGACCTGGCCAGCGTGGACAACAGCGAGTTCCAGCAGCTGCTGAACCAGGGCATCCCCGTGGCC

CCCCACACCACCGAGCCCATGCTGATGGAGTACCCCGAGGCCATCACCCGGCTGGTGACCGGCGCCCAGCGGCCCCCCGACCC

CGCCCCCGCCCCCCTGGGCGCCCCCGGCCTGCCCAACGGCCTGCTGAGCGGCGACGAGGACTTCAGCAGCATCGCCGACATGG

ACTTCAGCGCCCTGCTGGGCAGCGGCAGCGGCAGCCGGGACAGCCGGGAGGGCATGTTCCTGCCCAAGCCCGAGGCCGGCAGC

GCCATCAGCGACGTGTTCGAGGGCCGGGAGGTGTGCCAGCCCAAGCGGCTCCGGCCCTTCCACCCCCCCGGCAGCCCCTGGGC

CAACCGGCCCCTGCCCGCCAGCCTGGCCCCCACCCCCACCGGCCCCGTGCACGAGCCCGTGGGCAGCCTGACCCCCGCCCCCG

TGCCCCAGCCCCTGGACCCCGCCCCCGCCGTGACCCCCGAGGCCAGCCACCTGCTGGAGGACCCCGACGAGGAGACCAGCCAG

GCCGTGAAGGCCCTGCGGGAGATGGCCGACACCGTGATCCCCCAGAAGGAGGAGGCCGCCATCTGCGGCCAGATGGACCTGAG

CCACCCCCCCCCCGGGGCCACCTGGACGAGCTGACCACCACCCTGGAGAGCATGACCGAGGACCTGAACCTGGACAGCCCCC

TGACCCCCGAGCTGAACGAGATCCTGGACACCTTCCTGAACGACGAGTGCCTGCTGCACGCCATGCACATCAGCACCGGCCTG

AGCATCTTCGACACCAGCCTGTTCAGCGGCGGCAAGCGGCCCGCCGCCACCAAGAAGGCCGGCCAGGCCAAGAAGAAGAAGGG

CAGCTACCCCTACGACGTGCCCGACTACGCCTGAGCGGCCGCTTAATTAAGCTGCCTTCTGCGGGGCTTGCCTTCTGGCCATG

CCCTTCTTCTCTCCCTTGCACCTGTACCTCTTGGTCTTTGAATAAAGCCTGAGTAGGAAGTCTAGAAAAAAAAAAAAAAAAAA

AAAAAAAAAAAAAAAAAAAAAAAAAAAAAAAAAAAAAAAAAAAAAAAAAAAAAAAAAAAA
```

>TAL9 amino acid sequence

SEQ ID NO.: 210

GSHMVDLRTLGYSQQQQEKIKPKVRSTVAQHHEALVGHGFTHAHIVALSQHPAALGTVAVKYQDMIAALPEATHEAIVGVGKR
GAGARALEALLTVAGELRGPPLQLDTGQLLKIAKRGGVTAVEAVHAWRNALTGAPLULTPEQVVAIASUNGGKQALETVQRLL
PVLCQAHGLTPEQVVAIASNIGGKQALETVQRLLPVLCQAHGLTPEQVVAIASNIGGKQALETVQRLLPVLCQAHGLTPEQVV
AIASUGGGKQALETVQRLLPVLCQAHGLTPEQVVAIASUGGGKQALETVQRLLPVLCQAHGLTPEQVVAIASNIGGKQALETV
QRLLPVLCQAHGLTPEQVVAIASUNGGKQALETVQRLLPVLCQAHGLTPEQVVAIASUNGGKQALETVQRLLPVLCQAHGLTP
EQVVAIASUNGGKQALETVQRLLPVLCQAHGLTPEQVVAIASUNGGKQALETVQRLLPVLCQAHGLTPEQVVAIASNIGGKQA
LETVQRLLPVLCQAHGLTPEQVVAIASUGGGKQALETVQRLLPVLCQAHGLTPEQVVAIASHDGGKQALETVQRLLPVLCQAH
GLTPEQVVAIASUGGGKQALETVQRLLPVLCQAHGLTPEQVVAIASHDGGKQALETVQRLLPVLCQAHGLTPEQVVAIASUNG
GKQALETVQRLLPVLCQAHGLTPEQVVAIASUNGGKQALETVQRLLPVLCQAHGLTPEQVVAIASNIGGRPALESIVAQLSRP
DPALAALTNDHLVALACLGGRPALDAVKKGLPHAPALIKRTURRIPERTSHRVAS

>TAL9 mRNA sequence

SEQ ID NO.: 252

GGAUCCCAUAUGGUUGAUCUGCGUACCCUGGGUUAUAGCCAGCAGCAGCAAGAAAAAAUCAAACCGAAAGUUCGUAGCACCGU
UGCACAGCAUCAUGAAGCACUGGUUGGUCAUGGUUUUACCCAUGCACAUAUUGUUGCACUGAGCCAGCAUCCGGCAGCACUGG
GCACCGUUGCAGUUAAAUAUCAGGAUAUGAUUGCAGCACUGCCGGAAGCAACCCAUGAAGCAAUUGUUGGUGUUGGUAAACGC
GGAGCUGGUGCACGUGCCCUGGAAGCACUGCUGACCGUUGCCGGUGAACUGCGUGGUCCGCCUCUGCAGCUGGAUACCGGUCA
GCUGCUGAAAAUUGCAAAACGUGGUGGUGUUACCGCAGUUGAAGCAGUUCAUGCAUGGCGUAAUGCACUGACCGGUGCACCGC
UGAAUCUGACACCGGAACAGGUUGUUGCAAUUGCCAGCAAUAUGGUGGCAAACAGGCACUGGAAACCGUUCAGCGUCUGCUG
CCGGUUCUGUGUCAGGCACAUGGUCUGACCCCUGAACAGGUGGUGGCCAUUGCAAGCAACAUUGGCGGUAAACAAGCCCUGGA

-continued

```
AACAGUGCAGCGCCUGUUACCGGUGCUGUGCCAGGCCCAUGGCUUAACUCCGGAACAGGUGGUAGCGAUCGCAUCAAAUAUCG

GAGGUAAACAGGCCUUAGAAACCGUACAGCGCUUACUGCCGGUGUUAUGCCAGGCGCACGGCCUGACGCCAGAACAGGUAGUG

GCAAUCGCCUCAAAUGGUGGUGGAAAACAGGCGUUAGAGACAGUCCAGCGCCUGCUGCCUGUAUUAUGUCAAGCCCAUGGCCU

GACCCCAGAGCAAGUUGUUGCGAUUGCAAGUAAUGGCGGGGGUAAACAGGCACUUGAGACAGUUCAACGUUUACUGCCUGUAC

UGUGCCAAGCUCACGGUCUGACUCCGGAACAAGUCGUCGCGAUUGCGAGUAAUAUAGGUGGCAAACAAGCAUUAGAAACGGUG

CAACGCCUGCUGCCAGUUCUUUGCCAGGCUCACGGUUUAACCCCUGAGCAGGUUGUAGCUAUUGCGAGUAACAAUGGUGGUAA

GCAGGCGUUGGAAACUGUGCAAAGACUGCUGCCCGUGUUGUGCCAAGCACAUGGUUUAACCCCAGAACAAGUCGUAGCAAUCG

CAAGCAAUAAUGGUGGCAAGCAAGCGCUUGAAACAGUACAGCGUUUAUUACCGGUACUUUGUCAGGCCCACGGUCUUACACCA

GAACAAGUUGUGGCCAUAGCCAGUAACAAUGGCGGAAAGCAGGCUCUGGAAACGGUACAACGUCUGUUACCUGUUCUGUGUCA

AGCGCACGGAUUAACACCUGAACAAGUAGUUGCCAUUGCGUCAAAUAAUGGAGGCAAGCAGGCCUUGGAGACAGUGCAGAGAU

UACUGCCAGUGUUGUGUCAGGCUCAUGGCCUUACACCCGAGCAGGUCGUGGCAAUUGCAUCUAACAUUGGCGGUAAGCAAGCU

UUAGAGACUGUUCAGAGACUGCUUCCUGUCCUGUGCCAGGCACACGGACUUACGCCUGAGCAAGUGGUUGCAAUCGCCUCUAA

UGGGGGUGGUAAGCAAGCACUGGAAACUGUCCAACGCUUACUUCCGGUGCUUUGUCAAGCACACGGCUUAACGCCAGAGCAGG

UCGUCGCCAUAGCCAGCCAUGAUGGUGGUAAACAGGCCCUUGAAACGGUCCAAAGACUUCUGCCGGUCCUUUGCCAAGCGCAU

GGGCUGACACCUGAGCAGGUAGUCGCGAUUGCCUCAAACGGUGGUGGGAAGCAGGCAUUAGAAACAGUUCAAAGAUUAUUACC

AGUCCUGUGUCAGGCGCAUGGGUUAACCCCAGAGCAGGUAGUUGCAAUAGCAUCCCAUGACGGCGGAAAACAAGCGUUGGAAA

CGGUUCAGCGGUUAUUGCCUGUUUUGUGCCAGGCGCAUGGUUUGACACCCGAGCAAGUGGUAGCCAUAGCCUCAAACAAUGGG

GGUAAACAAGCUUUGGAGACAGUACAACGGCUGCUUCCAGUUUUAUGUCAGGCCCAUGGAUUGACGCCUGAACAAGUUGUCGC

UAUCGCAAGUAAUAAUGGUGGUAAACAAGCGCUUGAAACCGUUCAACGCCUUCUGCCUGUGCUUUGUCAGGCACAUGGAUUAA

CACCCGAACAGGUUGUCGCGAUAGCUUCAAAUAUCGGUGGUCGUCCGGCACUGGAAAGCAUUGUUGCACAGCUGAGCCGUCCU

GAUCCGGCACUGGCAGCACUGACCAAUGAUCAUCUGGUUGCACUGGCAUGUCGGGUGGUCGCCCUGCCCUGGAUGCAGUUAA

AAAAGGUCUGCCGCAUGCACCGGCACUGAUUAAACGUACCAAUCGUCGUAUUCCGGAACGUACCAGCCAUCGUGUUGCUAGC
```

EQUIVALENTS

Those skilled in the art will recognize, or be able to ascertain using no more than routine experimentation, many equivalents to the specific embodiments of the present invention described herein. Such equivalents are intended to be encompassed by the following claims.

SEQUENCE LISTING (2527 sequences)

SEQ ID NO: 1 - protein, 7 aa, Artificial Sequence
  source: /note="Description of Artificial Sequence: Synthetic peptide"
RKDALRG

SEQ ID NO: 2 - protein, 7 aa, Artificial Sequence
  source: /note="Description of Artificial Sequence: Synthetic peptide"
TTGALTE

SEQ ID NO: 3 - protein, 7 aa, Artificial Sequence
  source: /note="Description of Artificial Sequence: Synthetic peptide"
QRHHLVE

SEQ ID NO: 4 - protein, 7 aa, Artificial Sequence
  source: /note="Description of Artificial Sequence: Synthetic peptide"
QNSTLTE

SEQ ID NO: 5 - protein, 7 aa, Artificial Sequence
  source: /note="Description of Artificial Sequence: Synthetic peptide"
RNDALTE

SEQ ID NO: 6 - protein, 7 aa, Artificial Sequence
  source: /note="Description of Artificial Sequence: Synthetic peptide"
HKNALQN

SEQ ID NO: 7 - protein, 7 aa, Artificial Sequence
  source: /note="Description of Artificial Sequence: Synthetic peptide"
RRSACRR

SEQ ID NO: 8 - protein, 7 aa, Artificial Sequence
  source: /note="Description of Artificial Sequence: Synthetic peptide"
QKSSLIA

SEQ ID NO: 9 - protein, 7 aa, Artificial Sequence
  source: /note="Description of Artificial Sequence: Synthetic peptide"
RRDELNV

SEQ ID NO: 10 - protein, 7 aa, Artificial Sequence
  source: /note="Description of Artificial Sequence: Synthetic peptide"
TSGSLVR

SEQ ID NO: 11 - protein, 7 aa, Artificial Sequence
  source: /note="Description of Artificial Sequence: Synthetic peptide"
DPGALVR

SEQ ID NO: 12 - protein, 7 aa, Artificial Sequence
  source: /note="Description of Artificial Sequence: Synthetic peptide"
QSSSLVR

SEQ ID NO: 13 - protein, 7 aa, Artificial Sequence
  source: /note="Description of Artificial Sequence: Synthetic peptide"
RSDELVR

SEQ ID NO: 14 - protein, 7 aa, Artificial Sequence
  source: /note="Description of Artificial Sequence: Synthetic peptide"
RLRDIQF

SEQ ID NO: 15 - protein, 7 aa, Artificial Sequence
  source: /note="Description of Artificial Sequence: Synthetic peptide"
RSDERKR

SEQ ID NO: 16 - protein, 7 aa, Artificial Sequence
  source: /note="Description of Artificial Sequence: Synthetic peptide"
RSDHLTT

SEQ ID NO: 17 - protein, 7 aa, Artificial Sequence
  source: /note="Description of Artificial Sequence: Synthetic peptide"
RLRALDR

SEQ ID NO: 18 - protein, 7 aa, Artificial Sequence
  source: /note="Description of Artificial Sequence: Synthetic peptide"
TKNSLTE

SEQ ID NO: 19 - protein, 7 aa, Artificial Sequence
  source: /note="Description of Artificial Sequence: Synthetic peptide"
SKKHLAE

SEQ ID NO: 20 - protein, 7 aa, Artificial Sequence
  source: /note="Description of Artificial Sequence: Synthetic peptide"
TSHSLTE

SEQ ID NO: 21 - protein, 7 aa, Artificial Sequence
  source: /note="Description of Artificial Sequence: Synthetic peptide"
RNDTLTE

SEQ ID NO: 22 - protein, 7 aa, Artificial Sequence
  source: /note="Description of Artificial Sequence: Synthetic peptide"
THLDLIR

SEQ ID NO: 23 - protein, 7 aa, Artificial Sequence
  source: /note="Description of Artificial Sequence: Synthetic peptide"
DKKDLTR

SEQ ID NO: 24 - protein, 7 aa, Artificial Sequence
  source: /note="Description of Artificial Sequence: Synthetic peptide"
SPADLTR

SEQ ID NO: 25 - protein, 7 aa, Artificial Sequence
  source: /note="Description of Artificial Sequence: Synthetic peptide"
RTDTLRD

SEQ ID NO: 26 - protein, 7 aa, Artificial Sequence
  source: /note="Description of Artificial Sequence: Synthetic peptide"
TSGELVR

SEQ ID NO: 27 - protein, 7 aa, Artificial Sequence
  source: /note="Description of Artificial Sequence: Synthetic peptide"
DCRDLAR

SEQ ID NO: 28 - protein, 7 aa, Artificial Sequence
  source: /note="Description of Artificial Sequence: Synthetic peptide"
QSGDLRR

SEQ ID NO: 29 - protein, 7 aa, Artificial Sequence
  source: /note="Description of Artificial Sequence: Synthetic peptide"
RSDDLVR

SEQ ID NO: 30 - protein, 7 aa, Artificial Sequence
  source: /note="Description of Artificial Sequence: Synthetic peptide"
ARGNLRT

SEQ ID NO: 31 - protein, 7 aa, Artificial Sequence
  source: /note="Description of Artificial Sequence: Synthetic peptide"
SRGNLKS

SEQ ID NO: 32 - protein, 7 aa, Artificial Sequence
  source: /note="Description of Artificial Sequence: Synthetic peptide"
QASNLIS

SEQ ID NO: 33 - protein, 7 aa, Artificial Sequence
  source: /note="Description of Artificial Sequence: Synthetic peptide"
REDNLHT

SEQ ID NO: 34 - protein, 7 aa, Artificial Sequence
  source: /note="Description of Artificial Sequence: Synthetic peptide"
TSGNLTE

SEQ ID NO: 35 - protein, 7 aa, Artificial Sequence
  source: /note="Description of Artificial Sequence: Synthetic peptide"
SKKALTE

SEQ ID NO: 36 - protein, 7 aa, Artificial Sequence
  source: /note="Description of Artificial Sequence: Synthetic peptide"
QSGNLTE

SEQ ID NO: 37 - protein, 7 aa, Artificial Sequence
  source: /note="Description of Artificial Sequence: Synthetic peptide"
RADNLTE

SEQ ID NO: 38 - protein, 7 aa, Artificial Sequence
  source: /note="Description of Artificial Sequence: Synthetic peptide"
TTGNLTV

SEQ ID NO: 39 - protein, 7 aa, Artificial Sequence
  source: /note="Description of Artificial Sequence: Synthetic peptide"
DSGNLRV

SEQ ID NO: 40 - protein, 7 aa, Artificial Sequence
  source: /note="Description of Artificial Sequence: Synthetic peptide"
QRANLRA

SEQ ID NO: 41 - protein, 7 aa, Artificial Sequence
  source: /note="Description of Artificial Sequence: Synthetic peptide"
RKDNLKN

SEQ ID NO: 42 - protein, 7 aa, Artificial Sequence
  source: /note="Description of Artificial Sequence: Synthetic peptide"
TSGNLVR

SEQ ID NO: 43 - protein, 7 aa, Artificial Sequence
  source: /note="Description of Artificial Sequence: Synthetic peptide"
DPGNLVR

SEQ ID NO: 44 - protein, 7 aa, Artificial Sequence
  source: /note="Description of Artificial Sequence: Synthetic peptide"
QSSNLVR

SEQ ID NO: 45 - protein, 7 aa, Artificial Sequence
  source: /note="Description of Artificial Sequence: Synthetic peptide"
RSDNLVR

SEQ ID NO: 46 - protein, 7 aa, Artificial Sequence
  source: /note="Description of Artificial Sequence: Synthetic peptide"
APKALGW

SEQ ID NO: 47 - protein, 7 aa, Artificial Sequence
  source: /note="Description of Artificial Sequence: Synthetic peptide"
QAGHLAS

SEQ ID NO: 48 - protein, 7 aa, Artificial Sequence
  source: /note="Description of Artificial Sequence: Synthetic peptide"
RSDHLTT

SEQ ID NO: 49 - protein, 7 aa, Artificial Sequence
  source: /note="Description of Artificial Sequence: Synthetic peptide"
SRRTCRA

SEQ ID NO: 50 - protein, 7 aa, Artificial Sequence
  source: /note="Description of Artificial Sequence: Synthetic peptide"
HTGHLLE

SEQ ID NO: 51 - protein, 7 aa, Artificial Sequence
  source: /note="Description of Artificial Sequence: Synthetic peptide"
QSGHLTE

SEQ ID NO: 52 - protein, 7 aa, Artificial Sequence
  source: /note="Description of Artificial Sequence: Synthetic peptide"
RSDKLTE

SEQ ID NO: 53 - protein, 7 aa, Artificial Sequence
  source: /note="Description of Artificial Sequence: Synthetic peptide"
HRTTLTN

SEQ ID NO: 54 - protein, 7 aa, Artificial Sequence
  source: /note="Description of Artificial Sequence: Synthetic peptide"
ERSHLRE

SEQ ID NO: 55 - protein, 7 aa, Artificial Sequence
  source: /note="Description of Artificial Sequence: Synthetic peptide"
QLAHLRA

SEQ ID NO: 56 - protein, 7 aa, Artificial Sequence
  source: /note="Description of Artificial Sequence: Synthetic peptide"
RSDHLTN

SEQ ID NO: 57 - protein, 7 aa, Artificial Sequence
  source: /note="Description of Artificial Sequence: Synthetic peptide"
TSGHLVR

SEQ ID NO: 58 - protein, 7 aa, Artificial Sequence
  source: /note="Description of Artificial Sequence: Synthetic peptide"
DPGHLVR

SEQ ID NO: 59 - protein, 7 aa, Artificial Sequence
  source: /note="Description of Artificial Sequence: Synthetic peptide"
QRAHLER

SEQ ID NO: 60 - protein, 7 aa, Artificial Sequence
  source: /note="Description of Artificial Sequence: Synthetic peptide"
RSDKLVR

SEQ ID NO: 61 - protein, 11 aa, Artificial Sequence
  source: /note="Description of Artificial Sequence: Synthetic peptide"
YKCPECGKSFS

SEQ ID NO: 62 - protein, 5 aa, Artificial Sequence
  source: /note="Description of Artificial Sequence: Synthetic peptide"
HQRTH

SEQ ID NO: 63 - protein, 5 aa, Artificial Sequence
  source: /note="Description of Artificial Sequence: Synthetic peptide"
TGEKP

SEQ ID NO: 64 - DNA, 20 bp, Artificial Sequence
  source: /note="Description of Artificial Sequence: Synthetic oligonucleotide"
  modified_base (1)..(1): a, c, t, g, unknown or other
  modified_base (3)..(3): a, c, t, g, unknown or other
nbndccdshagrkgghrshv

SEQ ID NO: 65 - DNA, 20 bp, Artificial Sequence
  source: /note="Description of Artificial Sequence: Synthetic oligonucleotide"
  modified_base (18)..(18): a, c, t, g, unknown or other
  modified_base (20)..(20): a, c, t, g, unknown or other
vhsrhggkrgahsdccdnbn

SEQ ID NO: 66 - protein, 518 aa, Artificial Sequence
  source: /note="Description of Artificial Sequence: Synthetic polypeptide"
DALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRLRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLF

SEQ ID NO: 67 - protein, 617 aa, Homo sapiens
IFKPEELRQALMPTLEALYRQDPESLPFRQPVDPQLLGIPDYFDIVKSPMDLSTIKRKLDTGQYQEPWQYVDDIWLMFNNAWLYNRKTSRVYKYCSKLSEVFEQEIDPVMQSLGYCCGRKLEFSPQTLCCYGKQLCTIPRDATYYSYQNRYHFCEKCFNEIQGESVSLGDDPSQPQTTINKEQFSKRKNDTLDPELFVECTECGRKMHQICVLHHEIIWPAGFVCDGCLKKSARTRKENKFSAKRLPSTRLGTFLENRVNDFLRRQNHPESGEVTVRVVHASDKTVEVKPGMKARFVDSGEMAESFPYRTKALFAFEEIDGVDLCFFGMHVQEYGSDCPPPNQRRVYISYLDSVHFFRPKCLRTAVYHEILIGYLEYVKKLGYTTGHIWACPPSEGDDYIFHCHPPDQKIPKPKRLQEWYKKMLDKAVSERIVHDYKDIFKQATEDRLTSAKELPYFEGDFWPNVLEESIKELEQEEEERKREENTSNESTDVTKGDSKNAKKKNNKKTSKNKSSLSRGNKKKPGMPNVSNDLSQKLYATMEKHKEVFFVIRLIAGPAANSLPPIVDPDPLIPCDLMDGRDAFLTLARDKHLEFSSLRRAQWSTMCMLVELHTQSQD

SEQ ID NO: 68 - RNA, 100 nt, Artificial Sequence
  source: /note="Description of Artificial Sequence: Synthetic polynucleotide"
auugaauuaggggaucucggguuuuagagcuagaaauagcaaguuaaaauaaggcuaguccguuaucaacuugaaaaaguggcaccgagucggugcuuuu

SEQ ID NO: 69 - RNA, 100 nt, Artificial Sequence
  source: /note="Description of Artificial Sequence: Synthetic polynucleotide"
gacuuggggugacaauggcuguuuuagagcuagaaauagcaaguuaaaauaaggcuaguccguuaucaacuugaaaaaguggcaccgagucggugcuuuu

SEQ ID NO: 70 - RNA, 100 nt, Artificial Sequence
  source: /note="Description of Artificial Sequence: Synthetic polynucleotide"
aacugaacaucggugaguuaguuuuagagcuagaaauagcaaguuaaaauaaggcuaguccguuaucaacuugaaaaaguggcaccgagucggugcuuuu

SEQ ID NO: 71 - RNA, 100 nt, Artificial Sequence
  source: /note="Description of Artificial Sequence: Synthetic polynucleotide"
ugguuucuggcugacacccgguuuuagagcuagaaauagcaaguuaaaauaaggcuaguccguuaucaacuugaaaaaguggcaccgagucggugcuuuu

SEQ ID NO: 72 - RNA, 100 nt, Artificial Sequence
  source: /note="Description of Artificial Sequence: Synthetic polynucleotide"
augguuaaucggucccccgcguuuuagagcuagaaauagcaaguuaaaauaaggcuaguccguuaucaacuugaaaaaguggcaccgagucggugcuuuu

SEQ ID NO: 73 - RNA, 100 nt, Artificial Sequence
  source: /note="Description of Artificial Sequence: Synthetic polynucleotide"
guccucugggaagaucugcuguuuuagagcuagaaauagcaaguuaaaauaaggcuaguccguuaucaacuugaaaaaguggcaccgagucggugcuuuu

SEQ ID NO: 74 - RNA, 100 nt, Artificial Sequence
  source: /note="Description of Artificial Sequence: Synthetic polynucleotide"
gguuugaaaggaaggcagagguuuuagagcuagaaauagcaaguuaaaauaaggcuaguccguuaucaacuugaaaaaguggcaccgagucggugcuuuu

SEQ ID NO: 75 - RNA, 100 nt, Artificial Sequence
  source: /note="Description of Artificial Sequence: Synthetic polynucleotide"
acccugggcgcccaccccgaguuuuagagcuagaaauagcaaguuaaaauaaggcuaguccguuaucaacuugaaaaaguggcaccgagucggugcuuuu

SEQ ID NO: 76 - RNA, 100 nt, Artificial Sequence
  source: /note="Description of Artificial Sequence: Synthetic polynucleotide"
uucucccugccuccacgccgguuuuagagcuagaaauagcaaguuaaaauaaggcuaguccguuaucaacuugaaaaaguggcaccgagucggugcuuuu

SEQ ID NO: 77 - RNA, 100 nt, Artificial Sequence
  source: /note="Description of Artificial Sequence: Synthetic polynucleotide"
augcccccagcucuccggcuguuuuagagcuagaaauagcaaguuaaaauaaggcuaguccguuaucaacuugaaaaaguggcaccgagucggugcuuuu

SEQ ID NO: 78 - RNA, 100 nt, Artificial Sequence
  source: /note="Description of Artificial Sequence: Synthetic polynucleotide"
cagcgugaacgcgccccucgguuuuagagcuagaaauagcaaguuaaaauaaggcuaguccguuaucaacuugaaaaaguggcaccgagucggugcuuuu

SEQ ID NO: 79 - RNA, 100 nt, Artificial Sequence
  source: /note="Description of Artificial Sequence: Synthetic polynucleotide"
cuuacgguaaguggggcuggguuuuagagcuagaaauagcaaguuaaaauaaggcuaguccguuaucaacuugaaaaaguggcaccgagucggugcuuuu

SEQ ID NO: 80 - RNA, 100 nt, Artificial Sequence
  source: /note="Description of Artificial Sequence: Synthetic polynucleotide"
cccguaagaaacacacggggguuuuagagcuagaaauagcaaguuaaaauaaggcuaguccguuaucaacuugaaaaaguggcaccgagucggugcuuuu

SEQ ID NO: 81 - DNA, 20 bp, Artificial Sequence
  source: /note="Description of Artificial Sequence: Synthetic oligonucleotide"
aactgaacatcggtgagtta

SEQ ID NO: 82 - DNA, 20 bp, Artificial Sequence
  source: /note="Description of Artificial Sequence: Synthetic oligonucleotide"
taactcaccgatgttcagtt

SEQ ID NO: 83 - DNA, 20 bp, Artificial Sequence
  source: /note="Description of Artificial Sequence: Synthetic oligonucleotide"
tggtttctggctgacacccg

SEQ ID NO: 84 - DNA, 20 bp, Artificial Sequence
  source: /note="Description of Artificial Sequence: Synthetic oligonucleotide"
cgggtgtcagccagaaacca

SEQ ID NO: 85 - DNA, 20 bp, Artificial Sequence
  source: /note="Description of Artificial Sequence: Synthetic oligonucleotide"
atggttaatcggtcccccgc

SEQ ID NO: 86 - DNA, 20 bp, Artificial Sequence
  source: /note="Description of Artificial Sequence: Synthetic oligonucleotide"
gcgggggaccgattaaccat

SEQ ID NO: 87 - DNA, 20 bp, Artificial Sequence
  source: /note="Description of Artificial Sequence: Synthetic oligonucleotide"
gtcctctgggaagatctgct

SEQ ID NO: 88 - DNA, 20 bp, Artificial Sequence
  source: /note="Description of Artificial Sequence: Synthetic oligonucleotide"
agcagatcttcccagaggac

SEQ ID NO: 89 - DNA, 20 bp, Artificial Sequence
  source: /note="Description of Artificial Sequence: Synthetic oligonucleotide"
ggtttgaaaggaaggcagag

SEQ ID NO: 90 - DNA, 20 bp, Artificial Sequence
  source: /note="Description of Artificial Sequence: Synthetic oligonucleotide"
ctctgccttcctttcaaacc

SEQ ID NO: 91 - DNA, 20 bp, Artificial Sequence
  source: /note="Description of Artificial Sequence: Synthetic oligonucleotide"
accctgggcgcccaccccga

SEQ ID NO: 92 - DNA, 20 bp, Artificial Sequence
  source: /note="Description of Artificial Sequence: Synthetic oligonucleotide"
tcggggtgggcgcccagggt

SEQ ID NO: 93 - DNA, 20 bp, Artificial Sequence
  source: /note="Description of Artificial Sequence: Synthetic oligonucleotide"
ttctccctgcctccacgccg

SEQ ID NO: 94 - DNA, 20 bp, Artificial Sequence
  source: /note="Description of Artificial Sequence: Synthetic oligonucleotide"
cggcgtggaggcagggagaa

SEQ ID NO: 95 - protein, 1951 aa, Artificial Sequence
  source: /note="Description of Artificial Sequence: Synthetic polypeptide"
MAPKKKRKVGIHGVPAADKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVAAIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDKRPAATKKAGQAKKKKGRADALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRIRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFSGGKRPAATKKAGQAKKKKGSYPYDVPDYA

SEQ ID NO: 96 - RNA, 6097 nt, Artificial Sequence
  source: /note="Description of Artificial Sequence: Synthetic polynucleotide"
aggaaauaagagagaaaagaagaguaagaagaaauauaagagccaccauggcccccaagaagaagcggaaggugggcauccacggcgugcccgccgccgacaagaaguacagcaucggccuggccaucggcaccaacagcgugggcugggccgugaucaccgacgaguacaaggugcccagcaagaaguucaaggugcugggcaacaccgaccggcacagcaucaagaagaaccugaucggcgcccugcuguucgacagcggcgagaccgccgaggccacccggcugaagcggaccgcccggcggcgguacacccggcggaagaaccggaucugcuaccugcaggagaucuucagcaacgagauggccaagguggacgacagcuucuuccaccggcuggaggagagcuuccugguggaggaggacaagaagcacgagcggcaccccaucuucggcaacaucguggacgagguggccuaccacgagaaguaccccaccaucuaccaccugcggaagaagcugguggacagcaccgacaaggccgaccugcggcugaucuaccuggcccuggcccacaugaucaaguuccggggccacuuccugaucgagggcgaccugaaccccgacaacagcgacguggacaagcuguucauccagcuggugcagaccuacaaccagcuguucgaggagaaccccaucaacgccagcggcguggacgccaaggccauccugagcgcccggcugagcaagagccggcggcuggagaaccugaucgcccagcugcccggcgagaagaagaacggccuguucggcaaccugaucgcccugagccugggccugacccccaacuucaagagcaacuucgaccuggccgaggacgccaagcugcagcugagcaaggacaccuacgacgacgaccuggacaaccugcuggcccagaucggcgaccaguacgccgaccuguuccuggccgccaagaaccugagcgacgccauccugcugagcgacauccugcgggugaacaccgagaucaccaaggccccccugagcgccagcaugaucaagcgguacgacgagcaccaccaggaccugacccugcugaaggcccuggugcggcagcagcugcccgagaaguacaaggagaucuucuucgaccagagcaagaacggcuacgccggcuacaucgacggcggcgccagccaggaggaguucuacaaguucaucaagcccauccuggagaagauggacggcaccgaggagcugcuggugaagcugaaccgggaggaccugcugcggaagcagcggaccuucgacaacggcagcaucccccaccagauccaccugggcgagcugcacgccauccugcggcggcaggaggacuucuaccccuuccugaaggacaaccgggagaagaucgagaagauccugaccuuccggauccccuacuacgugggcccccuggcccggggcaacagccgguucgccuggaugacccggaaauccgaggagaccaucacccccuggaacuucgaggaggugguggacaagggcgccagcgcccagagcuucaucgagcggaugaccaacuucgacaagaaccugcccaacgagaaggugcugcccaagcacagccugcuguacgaguacuucaccguguacaacgagcugaccaaggugaaguacgugaccgagggcaugcggaagcccgccuuccugagcggcgagcagaagaaggccaucguggaccugcuguucaagaccaaccggaaggugaccgugaagcagcugaaggaggacuacuucaagaagaucgagugcuucgacagcguggagaucagcggcguggaggaccgguucaacgccagccugggcaccuaccacgaccugcugaagaucaucaaggacaaggacuuccuggacaacgaggagaacgaggacauccuggaggacaucgugcugacccugacccuguucgaggaccgggagaugaucgaggagcggcugaaaaccuacgcccaccuguucgacgacaaggugaugaagcagcugaagcggcggcgguacaccggcuggggccggcugagccggaagcugaucaacggcauccgggacaagcagagcggcaagaccauccuggacuuccugaaauccgacggcuucgccaaccggaacuucaugcagcugauccacgacgacagccugaccuucaaggaggacauccagaaggcccaggugagcggccagggcgacagccugcacgagcacaucgccaaccuggccggcagccccgccaucaagaagggcauccugcagaccgugaaggugguggacgagcuggugaaggugaugggccggcacaagcccgagaacaucgugaucgagauggcccgggagaaccagaccacccagaagggccagaagaacagccgggagcggaugaagcggaucgaggagggcaucaaggagcugggcagccagauccugaaggagcaccccguggagaacacccagcugcagaacgagaagcuguaccuguacuaccugcagaacggccgggacauguacguggaccaggagcuggacaucaaccggcugagcgacuacgacguggccgccaucgugccccagagcuuccugaaggacgacagcaucgacaacaaggugcugacccggagcgacaaggcccggggcaagagcgacaacgugcccagcgaggagguggugaagaagaugaagaacuacuggcggcagcugcugaacgccaagcugaucacccagcggaaguucgacaaccugaccaaggccgagcggggcggccugagcgagcuggacaaggccggcuucaucaagcggcagcugguggagacccggcagaucaccaagcacguggcccagauccuggacagccggaugaacaccaaguacgacgagaacgacaagcugauccgggaggugaaggugaucacccugaaauccaagcuggugagcgacuuccggaaggacuuccaguucuacaaggugcgggagaucaacaacuaccaccacgcccacgacgccuaccugaacgccguggugggcaccgcccugaucaagaaguaccccaagcuggagagcgaguucguguacggcgacuacaagguguacgacgugcggaagaugaucgccaagagcgagcaggagaucggcaaggccaccgccaaguacuucuucuacagcaacaucaugaacuucuucaagaccgagaucacccuggccaacggcgagauccggaagcggccccugaucgagaccaacggcgagaccggcgagaucgugugggacaagggccgggacuucgccaccgugcggaaggugcugagcaugccccaggugaacaucgugaagaaaaccgaggugcagaccggcggcuucagcaaggagagcauccugcccaagcggaacagcgacaagcugaucgcccggaagaaggacugggaccccaagaaguacggcggcuucgacagccccaccguggccuacagcgugcuggugguggccaagguggagaagggcaagagcaagaagcugaaauccgugaaggagcugcugggcaucaccaucauggagcggagcagcuucgagaagaaccccaucgacuuccuggaggccaagggcuacaaggaggugaagaaggaccugaucaucaagcugcccaaguacagccuguucgagcuggagaacggccggaagcggaugcuggccagcgccggcgagcugcagaagggcaacgagcuggcccugcccagcaaguacgugaacuuccuguaccuggccagccacuacgagaagcugaagggcagccccgaggacaacgagcagaagcagcuguucguggagcagcacaagcacuaccuggacgagaucaucgagcagaucagcgaguucagcaagcgggugauccuggccgacgccaaccuggacaaggugcugagcgccuacaacaagcaccgggacaagcccauccgggagcaggccgagaacaucauccaccuguucacccugaccaaccugggcgcccccgccgccuucaaguacuucgacaccaccaucgaccggaagcgguacaccagcaccaaggaggugcuggacgccacccugauccaccagagcaucaccggccuguacgagacccggaucgaccugagccagcugggcggcgacaagcggcccgccgccaccaagaaggccggccaggccaagaagaagaagggccgggccgacgcccuggacgacuucgaccuggacaugcugggcagcgacgcccuggacgacuucgaccuggacaugcugggcagcgacgcccuggacgacuucgaccuggacaugcugggcagcgacgcccuggacgacuucgaccuggacaugcugagcggcggccccaagaagaagcggaaggugggcagccaguaccugcccgacaccgacgaccggcaccggaucgaggagaagcggaagcggaccuacgagaccuucaagagcaucaugaagaaaucccccuucagcggccccaccgacccccggccccccccccggcggaucgccgugcccagccggagcagcgccagcgugcccaagcccgccccccagcccuaccccuucaccagcagccugagcaccaucaacuacgacgaguuccccaccaugguguuccccagcggccagaucagccaggccagcgcccuggcccccgcccccccccaggugcugccccaggcccccgcccccgcccccgcccccgccauggugagcgcccuggcccaggcccccgcccccgugcccgugcuggcccccggccccccccaggccguggccccccccgcccccaagcccacccaggccggcgagggcacccugagcgaggcccugcugcagcugcaguucgacgacgaggaccugggcgcccugcugggcaacagcaccgaccccgccguguucaccgaccuggccagcguggacaacagcgaguuccagcagcugcugaaccagggcauccccguggccccccacaccaccgagcccaugcugauggaguaccccgaggccaucacccggcuggugaccggcgcccagcggccccccgaccccgcccccgccccccugggcgcccccggccugcccaacggccugcugagcggcgacgaggacuucagcagcaucgccgacauggacuucagcgcccugcugggcagcggcagcggcagccgggacagccgggagggcauguuccugcccaagcccgaggccggcagcgccaucagcgacguguucgagggccgggaggugugccagcccaagcggauccggcccuuccacccccccggcagccccugggccaaccggccccugcccgccagccuggcccccacccccaccggccccgugcacgagcccgugggcagccugacccccgcccccgugccccagccccuggaccccgcccccgccgugacccccgaggccagccaccugcuggaggaccccgacgaggagaccagccaggccgugaaggcccugcgggagauggccgacaccgugaucccccagaaggaggaggccgccaucugcggccagauggaccugagccacccccccccccggggccaccuggacgagcugaccaccacccuggagagcaugaccgaggaccugaaccuggacagcccccugacccccgagcugaacgagauccuggacaccuuccugaacgacgagugccugcugcacgccaugcacaucagcaccggccugagcaucuucgacaccagccuguucagcggcggcaagcggcccgccgccaccaagaaggccggccaggccaagaagaagaagggcagcuaccccuacgacgugcccgacuacgccugagcggccgcuuaauuaagcugccuucugcggggcuugccuucuggccaugcccuucuucucucccuugcaccuguaccucuuggucuuugaauaaagccugaguaggaagucuagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 97 - protein, 1367 aa, Artificial Sequence
  source: /note="Description of Artificial Sequence: Synthetic polypeptide"
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVAAIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 98 - protein, 2050 aa, Artificial Sequence
  source: /note="Description of Artificial Sequence: Synthetic polypeptide"
MAPKKKRKVGIHGVPAADKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVAAIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDKRPAATKKAGQAKKKKGRAIFKPEELRQALMPTLEALYRQDPESLPFRQPVDPQLLGIPDYFDIVKSPMDLSTIKRKLDTGQYQEPWQYVDDIWLMFNNAWLYNRKTSRVYKYCSKLSEVFEQEIDPVMQSLGYCCGRKLEFSPQTLCCYGKQLCTIPRDATYYSYQNRYHFCEKCFNEIQGESVSLGDDPSQPQTTINKEQFSKRKNDTLDPELFVECTECGRKMHQICVLHHEIIWPAGFVCDGCLKKSARTRKENKFSAKRLPSTRLGTFLENRVNDFLRRQNHPESGEVTVRVVHASDKTVEVKPGMKARFVDSGEMAESFPYRTKALFAFEEIDGVDLCFFGMHVQEYGSDCPPPNQRRVYISYLDSVHFFRPKCLRTAVYHEILIGYLEYVKKLGYTTGHIWACPPSEGDDYIFHCHPPDQKIPKPKRLQEWYKKMLDKAVSERIVHDYKDIFKQATEDRLTSAKELPYFEGDFWPNVLEESIKELEQEEEERKREENTSNESTDVTKGDSKNAKKKNNKKTSKNKSSLSRGNKKKPGMPNVSNDLSQKLYATMEKHKEVFFVIRLIAGPAANSLPPIVDPDPLIPCDLMDGRDAFLTLARDKHLEFSSLRRAQWSTMCMLVELHTQSQDSGGKRPAATKKAGQAKKKKGSYPYDVPDYA

SEQ ID NO: 99 - RNA, 6394 nt, Artificial Sequence
  source: /note="Description of Artificial Sequence: Synthetic polynucleotide"
aggaaauaagagagaaaagaagaguaagaagaaauauaagagccaccauggcccccaagaagaagcggaaggugggcauccacggcgugcccgccgccgacaagaaguacagcaucggccuggccaucggcaccaacagcgugggcugggccgugaucaccgacgaguacaaggugcccagcaagaaguucaaggugcugggcaacaccgaccggcacagcaucaagaagaaccugaucggcgcccugcuguucgacagcggcgagaccgccgaggccacccggcugaagcggaccgcccggcggcgguacacccggcggaagaaccggaucugcuaccugcaggagaucuucagcaacgagauggccaagguggacgacagcuucuuccaccggcuggaggagagcuuccugguggaggaggacaagaagcacgagcggcaccccaucuucggcaacaucguggacgagguggccuaccacgagaaguaccccaccaucuaccaccugcggaagaagcugguggacagcaccgacaaggccgaccugcggcugaucuaccuggcccuggcccacaugaucaaguuccggggccacuuccugaucgagggcgaccugaaccccgacaacagcgacguggacaagcuguucauccagcuggugcagaccuacaaccagcuguucgaggagaaccccaucaacgccagcggcguggacgccaaggccauccugagcgcccggcugagcaagagccggcggcuggagaaccugaucgcccagcugcccggcgagaagaagaacggccuguucggcaaccugaucgcccugagccugggccugacccccaacuucaagagcaacuucgaccuggccgaggacgccaagcugcagcugagcaaggacaccuacgacgacgaccuggacaaccugcuggcccagaucggcgaccaguacgccgaccuguuccuggccgccaagaaccugagcgacgccauccugcugagcgacauccugcgggugaacaccgagaucaccaaggccccccugagcgccagcaugaucaagcgguacgacgagcaccaccaggaccugacccugcugaaggcccuggugcggcagcagcugcccgagaaguacaaggagaucuucuucgaccagagcaagaacggcuacgccggcuacaucgacggcggcgccagccaggaggaguucuacaaguucaucaagcccauccuggagaagauggacggcaccgaggagcugcuggugaagcugaaccgggaggaccugcugcggaagcagcggaccuucgacaacggcagcaucccccaccagauccaccugggcgagcugcacgccauccugcggcggcaggaggacuucuaccccuuccugaaggacaaccgggagaagaucgagaagauccugaccuuccggauccccuacuacgugggcccccuggcccggggcaacagccgguucgccuggaugacccggaaauccgaggagaccaucacccccuggaacuucgaggaggugguggacaagggcgccagcgcccagagcuucaucgagcggaugaccaacuucgacaagaaccugcccaacgagaaggugcugcccaagcacagccugcuguacgaguacuucaccguguacaacgagcugaccaaggugaaguacgugaccgagggcaugcggaagcccgccuuccugagcggcgagcagaagaaggccaucguggaccugcuguucaagaccaaccggaaggugaccgugaagcagcugaaggaggacuacuucaagaagaucgagugcuucgacagcguggagaucagcggcguggaggaccgguucaacgccagccugggcaccuaccacgaccugcugaagaucaucaaggacaaggacuuccuggacaacgaggagaacgaggacauccuggaggacaucgugcugacccugacccuguucgaggaccgggagaugaucgaggagcggcugaaaaccuacgcccaccuguucgacgacaaggugaugaagcagcugaagcggcggcgguacaccggcuggggccggcugagccggaagcugaucaacggcauccgggacaagcagagcggcaagaccauccuggacuuccugaaauccgacggcuucgccaaccggaacuucaugcagcugauccacgacgacagccugaccuucaaggaggacauccagaaggcccaggugagcggccagggcgacagccugcacgagcacaucgccaaccuggccggcagccccgccaucaagaagggcauccugcagaccgugaaggugguggacgagcuggugaaggugaugggccggcacaagcccgagaacaucgugaucgagauggcccgggagaaccagaccacccagaagggccagaagaacagccgggagcggaugaagcggaucgaggagggcaucaaggagcugggcagccagauccugaaggagcaccccguggagaacacccagcugcagaacgagaagcuguaccuguacuaccugcagaacggccgggacauguacguggaccaggagcuggacaucaaccggcugagcgacuacgacguggccgccaucgugccccagagcuuccugaaggacgacagcaucgacaacaaggugcugacccggagcgacaaggcccggggcaagagcgacaacgugcccagcgaggagguggugaagaagaugaagaacuacuggcggcagcugcugaacgccaagcugaucacccagcggaaguucgacaaccugaccaaggccgagcggggcggccugagcgagcuggacaaggccggcuucaucaagcggcagcugguggagacccggcagaucaccaagcacguggcccagauccuggacagccggaugaacaccaaguacgacgagaacgacaagcugauccgggaggugaaggugaucacccugaaauccaagcuggugagcgacuuccggaaggacuuccaguucuacaaggugcgggagaucaacaacuaccaccacgcccacgacgccuaccugaacgccguggugggcaccgcccugaucaagaaguaccccaagcuggagagcgaguucguguacggcgacuacaagguguacgacgugcggaagaugaucgccaagagcgagcaggagaucggcaaggccaccgccaaguacuucuucuacagcaacaucaugaacuucuucaagaccgagaucacccuggccaacggcgagauccggaagcggccccugaucgagaccaacggcgagaccggcgagaucgugugggacaagggccgggacuucgccaccgugcggaaggugcugagcaugccccaggugaacaucgugaagaaaaccgaggugcagaccggcggcuucagcaaggagagcauccugcccaagcggaacagcgacaagcugaucgcccggaagaaggacugggaccccaagaaguacggcggcuucgacagccccaccguggccuacagcgugcuggugguggccaagguggagaagggcaagagcaagaagcugaaauccgugaaggagcugcugggcaucaccaucauggagcggagcagcuucgagaagaaccccaucgacuuccuggaggccaagggcuacaaggaggugaagaaggaccugaucaucaagcugcccaaguacagccuguucgagcuggagaacggccggaagcggaugcuggccagcgccggcgagcugcagaagggcaacgagcuggcccugcccagcaaguacgugaacuuccuguaccuggccagccacuacgagaagcugaagggcagccccgaggacaacgagcagaagcagcuguucguggagcagcacaagcacuaccuggacgagaucaucgagcagaucagcgaguucagcaagcgggugauccuggccgacgccaaccuggacaaggugcugagcgccuacaacaagcaccgggacaagcccauccgggagcaggccgagaacaucauccaccuguucacccugaccaaccugggcgcccccgccgccuucaaguacuucgacaccaccaucgaccggaagcgguacaccagcaccaaggaggugcuggacgccacccugauccaccagagcaucaccggccuguacgagacccggaucgaccugagccagcugggcggcgacaagcggcccgccgccaccaagaaggccggccaggccaagaagaagaagggccgggccaucuucaagcccgaggagcugcggcaggcccugaugcccacccuggaggcccuguaccggcaggaccccgagagccugcccuuccggcagcccguggacccccagcugcugggcauccccgacuacuucgacaucgugaaaucccccauggaccugagcaccaucaagcggaagcuggacaccggccaguaccaggagcccuggcaguacguggacgacaucuggcugauguucaacaacgccuggcuguacaaccggaaaaccagccggguguacaaguacugcagcaagcugagcgagguguucgagcaggagaucgaccccgugaugcagagccugggcuacugcugcggccggaagcuggaguucagcccccagacccugugcugcuacggcaagcagcugugcaccaucccccgggacgccaccuacuacagcuaccagaaccgguaccacuucugcgagaagugcuucaacgagauccagggcgagagcgugagccugggcgacgaccccagccagccccagaccaccaucaacaaggagcaguucagcaagcggaagaacgacacccuggaccccgagcuguucguggagugcaccgagugcggccggaagaugcaccagaucugcgugcugcaccacgagaucaucuggcccgccggcuucgugugcgacggcugccugaagaaauccgcccggacccggaaggagaacaaguucagcgccaagcggcugcccagcacccggcugggcaccuuccuggagaaccgggugaacgacuuccugcggcggcagaaccaccccgagagcggcgaggugaccgugcggguggugcacgccagcgacaagaccguggaggugaagcccggcaugaaggcccgguucguggacagcggcgagauggccgagagcuuccccuaccggaccaaggcccuguucgccuucgaggagaucgacggcguggaccugugcuucuucggcaugcacgugcaggaguacggcagcgacugccccccccccaaccagcggcggguguacaucagcuaccuggacagcgugcacuucuuccggcccaagugccugcggaccgccguguaccacgagauccugaucggcuaccuggaguacgugaagaagcugggcuacaccaccggccacaucugggccugcccccccagcgagggcgacgacuacaucuuccacugccacccccccgaccagaagauccccaagcccaagcggcugcaggagugguacaagaagaugcuggacaaggccgugagcgagcggaucgugcacgacuacaaggacaucuucaagcaggccaccgaggaccggcugaccagcgccaaggagcugcccuacuucgagggcgacuucuggcccaacgugcuggaggagagcaucaaggagcuggagcaggaggaggaggagcggaagcgggaggagaacaccagcaacgagagcaccgacgugaccaagggcgacagcaagaacgccaagaagaagaacaacaagaaaaccagcaagaacaagagcagccugagccggggcaacaagaagaagcccggcaugcccaacgugagcaacgaccugagccagaagcuguacgccaccauggagaagcacaaggagguguucuucgugauccggcugaucgccggccccgccgccaacagccugccccccaucguggaccccgacccccugauccccugcgaccugauggacggccgggacgccuuccugacccuggcccgggacaagcaccuggaguucagcagccugcggcgggcccaguggagcaccaugugcaugcugguggagcugcacacccagagccaggacagcggcggcaagcggcccgccgccaccaagaaggccggccaggccaagaagaagaagggcagcuaccccuacgacgugcccgacuacgccugagcggccgcuuaauuaagcugccuucugcggggcuugccuucuggccaugcccuucuucucucccuugcaccuguaccucuuggucuuugaauaaagccugaguaggaagucuagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 100 - protein, 789 aa, Artificial Sequence
  source: /note="Description of Artificial Sequence: Synthetic polypeptide"
MAPKKKRKVGIHGVPAAGSSGSLEPGEKPYKCPECGKSFSRSDNLVRHQRTHTGEKPYKCPECGKSFSRSDHLTNHQRTHTGEKPYKCPECGKSFSDPGHLVRHQRTHTGEKPYKCPECGKSFSQRAHLERHQRTHTGEKPYKCPECGKSFSSRRTCRAHQRTHTGEKPYKCPECGKSFSRSDKLTEHQRTHTGEKPYKCPECGKSFSRNDTLTEHQRTHTGEKPTGKKTSASGSGGGSGGDALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRLRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFSGGKRPAATKKAGQAKKKKGSYPYDVPDYA

SEQ ID NO: 101 - RNA, 2611 nt, Artificial Sequence
  source: /note="Description of Artificial Sequence: Synthetic polynucleotide"
aggaaauaagagagaaaagaagaguaagaagaaauauaagagccaccauggcccccaagaagaagcggaaggugggcauccacggcgugcccgccgccggcagcagcggaucccuggagccgggugagaagccauacaagugcccagaaugcggcaagagcuuuagccgcagcgauaaucugguucgucaucagcgcacgcauacgggugagaaaccguacaaauguccagaaugcggcaaaagcuuuagucgcagcgaucaucugacgaaucaccagcgcacccauaccggcgaaaaaccguacaagugcccggagugcgguaaaagcuucagcgacccgggucaucuggugcgccaccaacgcacgcacaccggugagaaaccauauaaauguccagagugcggcaagaguuuuagccagcgugcccaucuggaacgucaucagcguacccacacgggugaaaaaccauauaagugcccggagugcgguaagaguuuuaguagccgccguacgugccgugcgcaccaacgcacccacaccggugaaaagccauacaaguguccggaaugcggcaagagcuucagccgcagcgacaaacucaccgaacaucaacguacccauacgggcgagaagccguacaaaugcccagaauguggcaaaagcuucagucgcaacgauacgcugaccgagcaucagcguacgcacaccggcgaaaagccaaccggcaagaaaaccagcgcuagcggcagcggcggcggcagcggcggcgacgcccuggacgacuucgaccuggacaugcugggcagcgacgcccuggacgacuucgaccuggacaugcugggcagcgacgcccuggacgacuucgaccuggacaugcugggcagcgacgcccuggacgacuucgaccuggacaugcugagcggcggccccaagaagaagcggaaggugggcagccaguaccugcccgacaccgacgaccggcaccggaucgaggagaagcggaagcggaccuacgagaccuucaagagcaucaugaagaaaucccccuucagcggccccaccgacccccggccccccccccggcggaucgccgugcccagccggagcagcgccagcgugcccaagcccgccccccagcccuaccccuucaccagcagccugagcaccaucaacuacgacgaguuccccaccaugguguuccccagcggccagaucagccaggccagcgcccuggcccccgcccccccccaggugcugccccaggcccccgcccccgcccccgcccccgccauggugagcgcccuggcccaggcccccgcccccgugcccgugcuggcccccggccccccccaggccguggccccccccgcccccaagcccacccaggccggcgagggcacccugagcgaggcccugcugcagcugcaguucgacgacgaggaccugggcgcccugcugggcaacagcaccgaccccgccguguucaccgaccuggccagcguggacaacagcgaguuccagcagcugcugaaccagggcauccccguggccccccacaccaccgagcccaugcugauggaguaccccgaggccaucacccggcuggugaccggcgcccagcggccccccgaccccgcccccgccccccugggcgcccccggccugcccaacggccugcugagcggcgacgaggacuucagcagcaucgccgacauggacuucagcgcccugcugggcagcggcagcggcagccgggacagccgggagggcauguuccugcccaagcccgaggccggcagcgccaucagcgacguguucgagggccgggaggugugccagcccaagcggcuccggcccuuccacccccccggcagccccugggccaaccggccccugcccgccagccuggcccccacccccaccggccccgugcacgagcccgugggcagccugacccccgcccccgugccccagccccuggaccccgcccccgccgugacccccgaggccagccaccugcuggaggaccccgacgaggagaccagccaggccgugaaggcccugcgggagauggccgacaccgugaucccccagaaggaggaggccgccaucugcggccagauggaccugagccacccccccccccggggccaccuggacgagcugaccaccacccuggagagcaugaccgaggaccugaaccuggacagcccccugacccccgagcugaacgagauccuggacaccuuccugaacgacgagugccugcugcacgccaugcacaucagcaccggccugagcaucuucgacaccagccuguucagcggcggcaagcggcccgccgccaccaagaaggccggccaggccaagaagaagaagggcagcuaccccuacgacgugcccgacuacgccugagcggccgcuuaauuaagcugccuucugcggggcuugccuucuggccaugcccuucuucucucccuugcaccuguaccucuuggucuuugaauaaagccugaguaggaagucuagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 102 - DNA, 21 bp, Homo sapiens
ccgcggcgtggaggcagggag

SEQ ID NO: 103 - protein, 209 aa, Artificial Sequence
  source: /note="Description of Artificial Sequence: Synthetic polypeptide"
LEPGEKPYKCPECGKSFSRSDNLVRHQRTHTGEKPYKCPECGKSFSRSDHLTNHQRTHTGEKPYKCPECGKSFSDPGHLVRHQRTHTGEKPYKCPECGKSFSQRAHLERHQRTHTGEKPYKCPECGKSFSSRRTCRAHQRTHTGEKPYKCPECGKSFSRSDKLTEHQRTHTGEKPYKCPECGKSFSRNDTLTEHQRTHTGEKPTGKKTS

SEQ ID NO: 104 - protein, 789 aa, Artificial Sequence
  source: /note="Description of Artificial Sequence: Synthetic polypeptide"
MAPKKKRKVGIHGVPAAGSSGSLEPGEKPYKCPECGKSFSQSSNLVRHQRTHTGEKPYKCPECGKSFSSKKHLAEHQRTHTGEKPYKCPECGKSFSSKKALTEHQRTHTGEKPYKCPECGKSFSDCRDLARHQRTHTGEKPYKCPECGKSFSDPGHLVRHQRTHTGEKPYKCPECGKSFSRNDALTEHQRTHTGEKPYKCPECGKSFSDKKDLTRHQRTHTGEKPTGKKTSASGSGGGSGGDALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRLRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFSGGKRPAATKKAGQAKKKKGSYPYDVPDYA

SEQ ID NO: 105 - RNA, 2512 nt, Artificial Sequence
  source: /note="Description of Artificial Sequence: Synthetic polynucleotide"
aggaaauaagagagaaaagaagaguaagaagaaauauaagagccaccauggcccccaagaagaagcggaaggugggcauccacggcgugcccgccgccggcagcagcggaucccuggaaccgggcgagaaaccguacaagugcccagaaugcgguaaaagcuucagccagagcaguaaucugguucgucaccagcgcacccacacgggugaaaagccauacaaauguccagagugugguaagaguuucaguagcaaaaagcaucuggcggaacaccaacguacgcauacgggugaaaagccguacaaguguccggaauguggcaagagcuuuagcagcaagaaggcgcugaccgaacaucagcguacccauaccggugaaaaaccauacaagugcccggagugcggcaaaaguuucagcgauugucgcgaucuggcccgucaucaacgcacccacaccggcgagaaaccauauaaguguccggagugcgguaaaagcuuuagcgauccgggccaucugguucgccaccaacgcacgcacaccggcgagaaaccguauaagugcccagagugcgguaagaguuuuagccguaacgaugcgcugacggagcaucagcgcacgcacacgggcgagaaaccauauaaaugcccggaaugugguaagagcuucagugacaaaaaggaucugacccgccaucaacguacgcauacgggcgagaagccaaccggcaagaaaaccagcgcuagcggcagcggcggcggcagcggcggcgacgcccuggacgacuucgaccuggacaugcugggcagcgacgcccuggacgacuucgaccuggacaugcugggcagcgacgcccuggacgacuucgaccuggacaugcugggcagcgacgcccuggacgacuucgaccuggacaugcugagcggcggccccaagaagaagcggaaggugggcagccaguaccugcccgacaccgacgaccggcaccggaucgaggagaagcggaagcggaccuacgagaccuucaagagcaucaugaagaaaucccccuucagcggccccaccgacccccggccccccccccggcggaucgccgugcccagccggagcagcgccagcgugcccaagcccgccccccagcccuaccccuucaccagcagccugagcaccaucaacuacgacgaguuccccaccaugguguuccccagcggccagaucagccaggccagcgcccuggcccccgcccccccccaggugcugccccaggcccccgcccccgcccccgcccccgccauggugagcgcccuggcccaggcccccgcccccgugcccgugcuggcccccggccccccccaggccguggccccccccgcccccaagcccacccaggccggcgagggcacccugagcgaggcccugcugcagcugcaguucgacgacgaggaccugggcgcccugcugggcaacagcaccgaccccgccguguucaccgaccuggccagcguggacaacagcgaguuccagcagcugcugaaccagggcauccccguggccccccacaccaccgagcccaugcugauggaguaccccgaggccaucacccggcuggugaccggcgcccagcggccccccgaccccgcccccgccccccugggcgcccccggccugcccaacggccugcugagcggcgacgaggacuucagcagcaucgccgacauggacuucagcgcccugcugggcagcggcagcggcagccgggacagccgggagggcauguuccugcccaagcccgaggccggcagcgccaucagcgacguguucgagggccgggaggugugccagcccaagcggcuccggcccuuccacccccccggcagccccugggccaaccggccccugcccgccagccuggcccccacccccaccggccccgugcacgagcccgugggcagccugacccccgcccccgugccccagccccuggaccccgcccccgccgugacccccgaggccagccaccugcuggaggaccccgacgaggagaccagccaggccgugaaggcccugcgggagauggccgacaccgugaucccccagaaggaggaggccgccaucugcggccagauggaccugagccacccccccccccggggccaccuggacgagcugaccaccacccuggagagcaugaccgaggaccugaaccuggacagcccccugacccccgagcugaacgagauccuggacaccuuccugaacgacgagugccugcugcacgccaugcacaucagcaccggccugagcaucuucgacaccagccuguucagcggcggcaagcggcccgccgccaccaagaaggccggccaggccaagaagaagaagggcagcuaccccuacgacgugcccgacuacgccugagcggccgcuuaauuaagcugccuucugcggggcuugccuucuggccaugcccuucuucucucccuugcaccuguaccucuuggucuuugaauaaa

SEQ ID NO: 106 - DNA, 21 bp, Homo sapiens
accctgggcgcccaccccgaa

SEQ ID NO: 107 - protein, 209 aa, Artificial Sequence
  source: /note="Description of Artificial Sequence: Synthetic polypeptide"
LEPGEKPYKCPECGKSFSQSSNLVRHQRTHTGEKPYKCPECGKSFSSKKHLAEHQRTHTGEKPYKCPECGKSFSSKKALTEHQRTHTGEKPYKCPECGKSFSDCRDLARHQRTHTGEKPYKCPECGKSFSDPGHLVRHQRTHTGEKPYKCPECGKSFSRNDALTEHQRTHTGEKPYKCPECGKSFSDKKDLTRHQRTHTGEKPTGKKTS

SEQ ID NO: 108 - protein, 789 aa, Artificial Sequence
  source: /note="Description of Artificial Sequence: Synthetic polypeptide"
MAPKKKRKVGIHGVPAAGSSGSLEPGEKPYKCPECGKSFSRSDNLVRHQRTHTGEKPYKCPECGKSFSQLAHLRAHQRTHTGEKPYKCPECGKSFSDPGHLVRHQRTHTGEKPYKCPECGKSFSQSSNLVRHQRTHTGEKPYKCPECGKSFSRKDNLKNHQRTHTGEKPYKCPECGKSFSQAGHLASHQRTHTGEKPYKCPECGKSFSTSGSLVRHQRTHTGEKPTGKKTSASGSGGGSGGDALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRLRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFSGGKRPAATKKAGQAKKKKGSYPYDVPDYA

SEQ ID NO: 109 - RNA, 2611 nt, Artificial Sequence
  source: /note="Description of Artificial Sequence: Synthetic polynucleotide"
aggaaauaagagagaaaagaagaguaagaagaaauauaagagccaccauggcccccaagaagaagcggaaggugggcauccacggcgugcccgccgccggcagcagcggaucccucgaaccgggcgagaaaccauauaaguguccggaaugugguaaaaguuuuagccgcagcgauaaucucgugcgucaccagcguacgcauaccggugagaagccauacaaguguccggaguguggcaaaagcuucagucagcuggcgcaucugcgcgcgcaucagcgcacccacaccggugagaaaccguacaaguguccagaaugcggcaaaagcuuuagcgauccgggucaucuggugcgucaucaacguacgcacacgggcgaaaaaccguacaaauguccggagugcggcaagagcuucagccagagcagcaaucugguucgccaccagcguacgcacaccggugaaaagccauacaagugcccggagugcggcaagaguuucagucgcaaggacaaucugaagaaccaucaacgcacccauacgggcgagaagccguacaaauguccggaaugcgguaaaaguuuuagccaagccggucaucuggccagccaucagcguacccauacgggugagaaaccguauaaauguccagaaugugguaagaguuucagcaccagcgguagucugguucgucaucaacgcacgcauacgggugaaaaaccaaccggcaagaaaaccagcgcuagcggcagcggcggcggcagcggcggcgacgcccuggacgacuucgaccuggacaugcugggcagcgacgcccuggacgacuucgaccuggacaugcugggcagcgacgcccuggacgacuucgaccuggacaugcugggcagcgacgcccuggacgacuucgaccuggacaugcugagcggcggccccaagaagaagcggaaggugggcagccaguaccugcccgacaccgacgaccggcaccggaucgaggagaagcggaagcggaccuacgagaccuucaagagcaucaugaagaaaucccccuucagcggccccaccgacccccggccccccccccggcggaucgccgugcccagccggagcagcgccagcgugcccaagcccgccccccagcccuaccccuucaccagcagccugagcaccaucaacuacgacgaguuccccaccaugguguuccccagcggccagaucagccaggccagcgcccuggcccccgcccccccccaggugcugccccaggcccccgcccccgcccccgcccccgccauggugagcgcccuggcccaggcccccgcccccgugcccgugcuggcccccggccccccccaggccguggccccccccgcccccaagcccacccaggccggcgagggcacccugagcgaggcccugcugcagcugcaguucgacgacgaggaccugggcgcccugcugggcaacagcaccgaccccgccguguucaccgaccuggccagcguggacaacagcgaguuccagcagcugcugaaccagggcauccccguggccccccacaccaccgagcccaugcugauggaguaccccgaggccaucacccggcuggugaccggcgcccagcggccccccgaccccgcccccgccccccugggcgcccccggccugcccaacggccugcugagcggcgacgaggacuucagcagcaucgccgacauggacuucagcgcccugcugggcagcggcagcggcagccgggacagccgggagggcauguuccugcccaagcccgaggccggcagcgccaucagcgacguguucgagggccgggaggugugccagcccaagcggcuccggcccuuccacccccccggcagccccugggccaaccggccccugcccgccagccuggcccccacccccaccggccccgugcacgagcccgugggcagccugacccccgcccccgugccccagccccuggaccccgcccccgccgugacccccgaggccagccaccugcuggaggaccccgacgaggagaccagccaggccgugaaggcccugcgggagauggccgacaccgugaucccccagaaggaggaggccgccaucugcggccagauggaccugagccacccccccccccggggccaccuggacgagcugaccaccacccuggagagcaugaccgaggaccugaaccuggacagcccccugacccccgagcugaacgagauccuggacaccuuccugaacgacgagugccugcugcacgccaugcacaucagcaccggccugagcaucuucgacaccagccuguucagcggcggcaagcggcccgccgccaccaagaaggccggccaggccaagaagaagaagggcagcuaccccuacgacgugcccgacuacgccugagcggccgcuuaauuaagcugccuucugcggggcuugccuucuggccaugcccuucuucucucccuugcaccuguaccucuuggucuuugaauaaagccugaguaggaagucuagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 110 - DNA, 21 bp, Homo sapiens
gtttgaaaggaaggcagagag

SEQ ID NO: 111 - protein, 209 aa, Artificial Sequence
  source: /note="Description of Artificial Sequence: Synthetic polypeptide"
LEPGEKPYKCPECGKSFSRSDNLVRHQRTHTGEKPYKCPECGKSFSQLAHLRAHQRTHTGEKPYKCPECGKSFSDPGHLVRHQRTHTGEKPYKCPECGKSFSQSSNLVRHQRTHTGEKPYKCPECGKSFSRKDNLKNHQRTHTGEKPYKCPECGKSFSQAGHLASHQRTHTGEKPYKCPECGKSFSTSGSLVRHQRTHTGEKPTGKKTS

SEQ ID NO: 112 - protein, 789 aa, Artificial Sequence
  source: /note="Description of Artificial Sequence: Synthetic polypeptide"
MAPKKKRKVGIHGVPAAGSSGSLEPGEKPYKCPECGKSFSQRAHLERHQRTHTGEKPYKCPECGKSFSQLAHLRAHQRTHTGEKPYKCPECGKSFSSKKHLAEHQRTHTGEKPYKCPECGKSFSTTGALTEHQRTHTGEKPYKCPECGKSFSTSGNLVRHQRTHTGEKPYKCPECGKSFSQSGDLRRHQRTHTGEKPYKCPECGKSFSTSHSLTEHQRTHTGEKPTGKKTSASGSGGGSGGDALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRLRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFSGGKRPAATKKAGQAKKKKGSYPYDVPDYA

SEQ ID NO: 113 - RNA, 2611 nt, Artificial Sequence
  source: /note="Description of Artificial Sequence: Synthetic polynucleotide"
aggaaauaagagagaaaagaagaguaagaagaaauauaagagccaccauggcccccaagaagaagcggaaggugggcauccacggcgugcccgccgccggcagcagcggaucccucgaaccgggcgaaaagccguauaagugcccggaaugcggcaagaguuuuagccagcgcgcccaucuggaacgucaccagcguacccauaccggugaaaagccauauaaaugcccagaaugugguaaaagcuuuagucagcuggcccaucugcgcgcccaccaacguacgcacacgggcgagaagccguacaaaugcccagaaugcgguaaaagcuucagcagcaaaaagcaucuggcggaacaucaacguacccacaccggcgagaaaccauacaagugcccggaaugcgguaaaagcuucagcaccaccggugcgcugacggagcaucagcgcacccacacgggcgaaaaaccguauaaguguccggaguguggcaaaaguuuuaguaccagcggcaaucuggugcgccaucaacguacgcauaccggcgagaagccauauaaauguccagaguguggcaagagcuuuagccaaagcggugaucugcgucgccaccaacgcacgcacaccggcgaaaaaccauacaaauguccggaaugcgguaagaguuucagcacgagccauagucugaccgaacaucaacguacccauacgggugagaaaccaaccggcaagaaaaccagcgcuagcggcagcggcggcggcagcggcggcgacgcccuggacgacuucgaccuggacaugcugggcagcgacgcccuggacgacuucgaccuggacaugcugggcagcgacgcccuggacgacuucgaccuggacaugcugggcagcgacgcccuggacgacuucgaccuggacaugcugagcggcggccccaagaagaagcggaaggugggcagccaguaccugcccgacaccgacgaccggcaccggaucgaggagaagcggaagcggaccuacgagaccuucaagagcaucaugaagaaaucccccuucagcggccccaccgacccccggccccccccccggcggaucgccgugcccagccggagcagcgccagcgugcccaagcccgccccccagcccuaccccuucaccagcagccugagcaccaucaacuacgacgaguuccccaccaugguguuccccagcggccagaucagccaggccagcgcccuggcccccgcccccccccaggugcugccccaggcccccgcccccgcccccgcccccgccauggugagcgcccuggcccaggcccccgcccccgugcccgugcuggcccccggccccccccaggccguggccccccccgcccccaagcccacccaggccggcgagggcacccugagcgaggcccugcugcagcugcaguucgacgacgaggaccugggcgcccugcugggcaacagcaccgaccccgccguguucaccgaccuggccagcguggacaacagcgaguuccagcagcugcugaaccagggcauccccguggccccccacaccaccgagcccaugcugauggaguaccccgaggccaucacccggcuggugaccggcgcccagcggccccccgaccccgcccccgccccccugggcgcccccggccugcccaacggccugcugagcggcgacgaggacuucagcagcaucgccgacauggacuucagcgcccugcugggcagcggcagcggcagccgggacagccgggagggcauguuccugcccaagcccgaggccggcagcgccaucagcgacguguucgagggccgggaggugugccagcccaagcggcuccggcccuuccacccccccggcagccccugggccaaccggccccugcccgccagccuggcccccacccccaccggccccgugcacgagcccgugggcagccugacccccgcccccgugccccagccccuggaccccgcccccgccgugacccccgaggccagccaccugcuggaggaccccgacgaggagaccagccaggccgugaaggcccugcgggagauggccgacaccgugaucccccagaaggaggaggccgccaucugcggccagauggaccugagccacccccccccccggggccaccuggacgagcugaccaccacccuggagagcaugaccgaggaccugaaccuggacagcccccugacccccgagcugaacgagauccuggacaccuuccugaacgacgagugccugcugcacgccaugcacaucagcaccggccugagcaucuucgacaccagccuguucagcggcggcaagcggcccgccgccaccaagaaggccggccaggccaagaagaagaagggcagcuaccccuacgacgugcccgacuacgccugagcggccgcuuaauuaagcugccuucugcggggcuugccuucuggccaugcccuucuucucucccuugcaccuguaccucuuggucuuugaauaaagccugaguaggaagucuagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 114 - DNA, 21 bp, Homo sapiens
ccagcagatcttcccagagga

SEQ ID NO: 115 - protein, 209 aa, Artificial Sequence
  source: /note="Description of Artificial Sequence: Synthetic polypeptide"
LEPGEKPYKCPECGKSFSQRAHLERHQRTHTGEKPYKCPECGKSFSQLAHLRAHQRTHTGEKPYKCPECGKSFSSKKHLAEHQRTHTGEKPYKCPECGKSFSTTGALTEHQRTHTGEKPYKCPECGKSFSTSGNLVRHQRTHTGEKPYKCPECGKSFSQSGDLRRHQRTHTGEKPYKCPECGKSFSTSHSLTEHQRTHTGEKPTGKKTS

SEQ ID NO: 116 - protein, 789 aa, Artificial Sequence
  source: /note="Description of Artificial Sequence: Synthetic polypeptide"
MAPKKKRKVGIHGVPAAGSSGSLEPGEKPYKCPECGKSFSTSGNLTEHQRTHTGEKPYKCPECGKSFSDSGNLRVHQRTHTGEKPYKCPECGKSFSHKNALQNHQRTHTGEKPYKCPECGKSFSRNDTLTEHQRTHTGEKPYKCPECGKSFSQRAHLERHQRTHTGEKPYKCPECGKSFSRSDKLVRHQRTHTGEKPYKCPECGKSFSDPGHLVRHQRTHTGEKPTGKKTSASGSGGGSGGDALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRLRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFSGGKRPAATKKAGQAKKKKGSYPYDVPDYA

SEQ ID NO: 117 - RNA, 2611 nt, Artificial Sequence
  source: /note="Description of Artificial Sequence: Synthetic polynucleotide"
aggaaauaagagagaaaagaagaguaagaagaaauauaagagccaccauggcccccaagaagaagcggaaggugggcauccacggcgugcccgccgccggcagcagcggaucccucgaaccgggcgagaaaccauauaaguguccagagugugguaagagcuuuagcaccaguggcaaucugaccgagcaucaacgcacgcauacgggugagaaaccguacaagugcccggaaugcggcaaaaguuucagcgauagcggcaaucugcgugugcaccagcguacgcauacgggcgaaaagccguauaagugcccagaaugcgguaagaguuuuagccacaaaaacgcgcugcagaaccaccagcgcacccacacgggugagaagccauacaaauguccggaaugcggcaaaagcuucagccgcaacgauacgcugacggaacaccaacguacgcauaccggcgaaaagccauacaagugcccggagugcgguaaaagcuuuagccagcgcgcgcaucucgaacgucaucaacguacccauaccggugaaaaaccauauaaaugcccggaaugugguaaaaguuuuagccgcagcgacaaacuggugcgucaucaacgcacccauaccggugaaaagccauauaagugcccggagugugguaaaagcuucagcgauccgggucaucugguucgccaucaacguacgcacaccggcgagaagccaaccggcaagaaaaccagcgcuagcggcagcggcggcggcagcggcggcgacgcccuggacgacuucgaccuggacaugcugggcagcgacgcccuggacgacuucgaccuggacaugcugggcagcgacgcccuggacgacuucgaccuggacaugcugggcagcgacgcccuggacgacuucgaccuggacaugcugagcggcggccccaagaagaagcggaaggugggcagccaguaccugcccgacaccgacgaccggcaccggaucgaggagaagcggaagcggaccuacgagaccuucaagagcaucaugaagaaaucccccuucagcggccccaccgacccccggccccccccccggcggaucgccgugcccagccggagcagcgccagcgugcccaagcccgccccccagcccuaccccuucaccagcagccugagcaccaucaacuacgacgaguuccccaccaugguguuccccagcggccagaucagccaggccagcgcccuggcccccgcccccccccaggugcugccccaggcccccgcccccgcccccgcccccgccauggugagcgcccuggcccaggcccccgcccccgugcccgugcuggcccccggccccccccaggccguggccccccccgcccccaagcccacccaggccggcgagggcacccugagcgaggcccugcugcagcugcaguucgacgacgaggaccugggcgcccugcugggcaacagcaccgaccccgccguguucaccgaccuggccagcguggacaacagcgaguuccagcagcugcugaaccagggcauccccguggccccccacaccaccgagcccaugcugauggaguaccccgaggccaucacccggcuggugaccggcgcccagcggccccccgaccccgcccccgccccccugggcgcccccggccugcccaacggccugcugagcggcgacgaggacuucagcagcaucgccgacauggacuucagcgcccugcugggcagcggcagcggcagccgggacagccgggagggcauguuccugcccaagcccgaggccggcagcgccaucagcgacguguucgagggccgggaggugugccagcccaagcggcuccggcccuuccacccccccggcagccccugggccaaccggccccugcccgccagccuggcccccacccccaccggccccgugcacgagcccgugggcagccugacccccgcccccgugccccagccccuggaccccgcccccgccgugacccccgaggccagccaccugcuggaggaccccgacgaggagaccagccaggccgugaaggcccugcgggagauggccgacaccgugaucccccagaaggaggaggccgccaucugcggccagauggaccugagccacccccccccccggggccaccuggacgagcugaccaccacccuggagagcaugaccgaggaccugaaccuggacagcccccugacccccgagcugaacgagauccuggacaccuuccugaacgacgagugccugcugcacgccaugcacaucagcaccggccugagcaucuucgacaccagccuguucagcggcggcaagcggcccgccgccaccaagaaggccggccaggccaagaagaagaagggcagcuaccccuacgacgugcccgacuacgccugagcggccgcuuaauuaagcugccuucugcggggcuugccuucuggccaugcccuucuucucucccuugcaccuguaccucuuggucuuugaauaaagccugaguaggaagucuagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 118 - DNA, 21 bp, Homo sapiens
ggcgggggaccgattaaccat

SEQ ID NO: 119 - protein, 209 aa, Artificial Sequence
  source: /note="Description of Artificial Sequence: Synthetic polypeptide"
LEPGEKPYKCPECGKSFSTSGNLTEHQRTHTGEKPYKCPECGKSFSDSGNLRVHQRTHTGEKPYKCPECGKSFSHKNALQNHQRTHTGEKPYKCPECGKSFSRNDTLTEHQRTHTGEKPYKCPECGKSFSQRAHLERHQRTHTGEKPYKCPECGKSFSRSDKLVRHQRTHTGEKPYKCPECGKSFSDPGHLVRHQRTHTGEKPTGKKTS

SEQ ID NO: 120 - protein, 789 aa, Artificial Sequence
  source: /note="Description of Artificial Sequence: Synthetic polypeptide"
MAPKKKRKVGIHGVPAAGSSGSLEPGEKPYKCPECGKSFSTSHSLTEHQRTHTGEKPYKCPECGKSFSQRANLRAHQRTHTGEKPYKCPECGKSFSRADNLTEHQRTHTGEKPYKCPECGKSFSERSHLREHQRTHTGEKPYKCPECGKSFSDPGALVRHQRTHTGEKPYKCPECGKSFSTSGHLVRHQRTHTGEKPYKCPECGKSFSRNDTLTEHQRTHTGEKPTGKKTSASGSGGGSGGDALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRLRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFSGGKRPAATKKAGQAKKKKGSYPYDVPDYA

SEQ ID NO: 121 - RNA, 2611 nt, Artificial Sequence
  source: /note="Description of Artificial Sequence: Synthetic polynucleotide"
aggaaauaagagagaaaagaagaguaagaagaaauauaagagccaccauggcccccaagaagaagcggaaggugggcauccacggcgugcccgccgccggcagcagcggaucccucgaaccgggcgaaaaaccguauaaguguccggagugcggcaagagcuucagcacgagccauagucugaccgaacaccagcgcacccacacgggcgaaaagccguacaaauguccagagugugguaagaguuucagccagcgugccaaucugcgcgcccaccaacguacccacaccggugagaagccguauaagugcccagagugugguaaaagcuucagccgcgccgauaaucugacggagcaccaacgcacccacaccggcgaaaagccauacaagugcccggaguguggcaagagcuuuagcgaacgcagccaucugcgcgaacaccaacguacgcacacgggugagaaaccauacaaauguccagaaugugguaaaaguuuuagcgauccgggcgcgcugguucgccaccagcgcacgcacaccggugaaaagccguauaaauguccagaaugcggcaaaagcuucaguaccagcggucaucugguucgucaucagcguacccauaccggcgagaagccauauaagugcccggaguguggcaaaaguuucagccgcaaugauacgcugaccgagcaucagcguacgcauaccggugaaaaaccaaccggcaagaaaaccagcgcuagcggcagcggcggcggcagcggcggcgacgcccuggacgacuucgaccuggacaugcugggcagcgacgcccuggacgacuucgaccuggacaugcugggcagcgacgcccuggacgacuucgaccuggacaugcugggcagcgacgcccuggacgacuucgaccuggacaugcugagcggcggccccaagaagaagcggaaggugggcagccaguaccugcccgacaccgacgaccggcaccggaucgaggagaagcggaagcggaccuacgagaccuucaagagcaucaugaagaaaucccccuucagcggccccaccgacccccggccccccccccggcggaucgccgugcccagccggagcagcgccagcgugcccaagcccgccccccagcccuaccccuucaccagcagccugagcaccaucaacuacgacgaguuccccaccaugguguuccccagcggccagaucagccaggccagcgcccuggcccccgcccccccccaggugcugccccaggcccccgcccccgcccccgcccccgccauggugagcgcccuggcccaggcccccgcccccgugcccgugcuggcccccggccccccccaggccguggccccccccgcccccaagcccacccaggccggcgagggcacccugagcgaggcccugcugcagcugcaguucgacgacgaggaccugggcgcccugcugggcaacagcaccgaccccgccguguucaccgaccuggccagcguggacaacagcgaguuccagcagcugcugaaccagggcauccccguggccccccacaccaccgagcccaugcugauggaguaccccgaggccaucacccggcuggugaccggcgcccagcggccccccgaccccgcccccgccccccugggcgcccccggccugcccaacggccugcugagcggcgacgaggacuucagcagcaucgccgacauggacuucagcgcccugcugggcagcggcagcggcagccgggacagccgggagggcauguuccugcccaagcccgaggccggcagcgccaucagcgacguguucgagggccgggaggugugccagcccaagcggcuccggcccuuccacccccccggcagccccugggccaaccggccccugcccgccagccuggcccccacccccaccggccccgugcacgagcccgugggcagccugacccccgcccccgugccccagccccuggaccccgcccccgccgugacccccgaggccagccaccugcuggaggaccccgacgaggagaccagccaggccgugaaggcccugcgggagauggccgacaccgugaucccccagaaggaggaggccgccaucugcggccagauggaccugagccacccccccccccggggccaccuggacgagcugaccaccacccuggagagcaugaccgaggaccugaaccuggacagcccccugacccccgagcugaacgagauccuggacaccuuccugaacgacgagugccugcugcacgccaugcacaucagcaccggccugagcaucuucgacaccagccuguucagcggcggcaagcggcccgccgccaccaagaaggccggccaggccaagaagaagaagggcagcuaccccuacgacgugcccgacuacgccugagcggccgcuuaauuaagcugccuucugcggggcuugccuucuggccaugcccuucuucucucccuugcaccuguaccucuuggucuuugaauaaagccugaguaggaagucuagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 122 - DNA, 21 bp, Homo sapiens
ccgggtgtcagccagaaacca

SEQ ID NO: 123 - protein, 209 aa, Artificial Sequence
  source: /note="Description of Artificial Sequence: Synthetic polypeptide"
LEPGEKPYKCPECGKSFSTSHSLTEHQRTHTGEKPYKCPECGKSFSQRANLRAHQRTHTGEKPYKCPECGKSFSRADNLTEHQRTHTGEKPYKCPECGKSFSERSHLREHQRTHTGEKPYKCPECGKSFSDPGALVRHQRTHTGEKPYKCPECGKSFSTSGHLVRHQRTHTGEKPYKCPECGKSFSRNDTLTEHQRTHTGEKPTGKKTS

SEQ ID NO: 124 - protein, 789 aa, Artificial Sequence
  source: /note="Description of Artificial Sequence: Synthetic polypeptide"
MAPKKKRKVGIHGVPAAGSSGSLEPGEKPYKCPECGKSFSRSDHLTNHQRTHTGEKPYKCPECGKSFSTSGSLVRHQRTHTGEKPYKCPECGKSFSQAGHLASHQRTHTGEKPYKCPECGKSFSRSDKLTEHQRTHTGEKPYKCPECGKSFSTSGNLTEHQRTHTGEKPYKCPECGKSFSQSSNLVRHQRTHTGEKPYKCPECGKSFSTHLDLIRHQRTHTGEKPTGKKTSASGSGGGSGGDALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRLRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFSGGKRPAATKKAGQAKKKKGSYPYDVPDYA

SEQ ID NO: 125 - RNA, 2611 nt, Artificial Sequence
  source: /note="Description of Artificial Sequence: Synthetic polynucleotide"
aggaaauaagagagaaaagaagaguaagaagaaauauaagagccaccauggcccccaagaagaagcggaaggugggcauccacggcgugcccgccgccggcagcagcggaucccuggaaccgggcgagaagccauacaagugcccagagugcggcaaaagcuucagccgcagcgaccaucugaccaaucaccaacgcacccauaccggugagaagccguacaaaugcccagagugcgguaagagcuuuaguaccaguggcagucugguucgucaucagcgcacgcacacgggcgaaaaaccauacaaaugcccggagugcggcaaaagcuuuagccaagccggucaucuggcgagccaucaacguacgcacaccggcgagaagccguauaaauguccggagugcgguaagagcuuuagccguagcgauaaacugaccgaacaccaacguacgcauacgggcgagaaaccauauaaauguccagaguguggcaagaguuucagcaccagcggcaaucugaccgagcaucaacguacccauaccggugaaaagccauauaaauguccagaaugcgguaagaguuuuagucagagcaguaaucuggugcgccaucagcguacccacacgggugagaaaccauauaaguguccggaaugcggcaagaguuuuagcacccaucuggaucugauccgucaucagcgcacccacaccggugaaaaaccaaccggcaagaaaaccagugcuagcggcagcggcggcggcagcggcggcgacgcccuggacgacuucgaccuggacaugcugggcagcgacgcccuggacgacuucgaccuggacaugcugggcagcgacgcccuggacgacuucgaccuggacaugcugggcagcgacgcccuggacgacuucgaccuggacaugcugagcggcggccccaagaagaagcggaaggugggcagccaguaccugcccgacaccgacgaccggcaccggaucgaggagaagcggaagcggaccuacgagaccuucaagagcaucaugaagaaaucccccuucagcggccccaccgacccccggccccccccccggcggaucgccgugcccagccggagcagcgccagcgugcccaagcccgccccccagcccuaccccuucaccagcagccugagcaccaucaacuacgacgaguuccccaccaugguguuccccagcggccagaucagccaggccagcgcccuggcccccgcccccccccaggugcugccccaggcccccgcccccgcccccgcccccgccauggugagcgcccuggcccaggcccccgcccccgugcccgugcuggcccccggccccccccaggccguggccccccccgcccccaagcccacccaggccggcgagggcacccugagcgaggcccugcugcagcugcaguucgacgacgaggaccugggcgcccugcugggcaacagcaccgaccccgccguguucaccgaccuggccagcguggacaacagcgaguuccagcagcugcugaaccagggcauccccguggccccccacaccaccgagcccaugcugauggaguaccccgaggccaucacccggcuggugaccggcgcccagcggccccccgaccccgcccccgccccccugggcgcccccggccugcccaacggccugcugagcggcgacgaggacuucagcagcaucgccgacauggacuucagcgcccugcugggcagcggcagcggcagccgggacagccgggagggcauguuccugcccaagcccgaggccggcagcgccaucagcgacguguucgagggccgggaggugugccagcccaagcggcuccggcccuuccacccccccggcagccccugggccaaccggccccugcccgccagccuggcccccacccccaccggccccgugcacgagcccgugggcagccugacccccgcccccgugccccagccccuggaccccgcccccgccgugacccccgaggccagccaccugcuggaggaccccgacgaggagaccagccaggccgugaaggcccugcgggagauggccgacaccgugaucccccagaaggaggaggccgccaucugcggccagauggaccugagccacccccccccccggggccaccuggacgagcugaccaccacccuggagagcaugaccgaggaccugaaccuggacagcccccugacccccgagcugaacgagauccuggacaccuuccugaacgacgagugccugcugcacgccaugcacaucagcaccggccugagcaucuucgacaccagccuguucagcggcggcaagcggcccgccgccaccaagaaggccggccaggccaagaagaagaagggcagcuaccccuacgacgugcccgacuacgccugagcggccgcuuaauuaagcugccuucugcggggcuugccuucuggccaugcccuucuucucucccuugcaccuguaccucuuggucuuugaauaaagccugaguaggaagucuagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 126 - DNA, 21 bp, Homo sapiens
actgaacatcggtgagttagg

SEQ ID NO: 127 - protein, 209 aa, Artificial Sequence
  source: /note="Description of Artificial Sequence: Synthetic polypeptide"
LEPGEKPYKCPECGKSFSRSDHLTNHQRTHTGEKPYKCPECGKSFSTSGSLVRHQRTHTGEKPYKCPECGKSFSQAGHLASHQRTHTGEKPYKCPECGKSFSRSDKLTEHQRTHTGEKPYKCPECGKSFSTSGNLTEHQRTHTGEKPYKCPECGKSFSQSSNLVRHQRTHTGEKPYKCPECGKSFSTHLDLIRHQRTHTGEKPTGKKTS

SEQ ID NO: 128 - protein, 789 aa, Artificial Sequence
  source: /note="Description of Artificial Sequence: Synthetic polypeptide"
MAPKKKRKVGIHGVPAAGSSGSLEPGEKPYKCPECGKSFSRSDHLTTHQRTHTGEKPYKCPECGKSFSTSGELVRHQRTHTGEKPYKCPECGKSFSRRDELNVHQRTHTGEKPYKCPECGKSFSSPADLTRHQRTHTGEKPYKCPECGKSFSRSDELVRHQRTHTGEKPYKCPECGKSFSRSDKLVRHQRTHTGEKPYKCPECGKSFSTTGALTEHQRTHTGEKPTGKKTSASGSGGGSGGDALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRLRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFSGGKRPAATKKAGQAKKKKGSYPYDVPDYA

SEQ ID NO: 129 - RNA, 2611 nt, Artificial Sequence
  source: /note="Description of Artificial Sequence: Synthetic polynucleotide"
aggaaauaagagagaaaagaagaguaagaagaaauauaagagccaccauggcccccaagaagaagcggaaggugggcauccacggcgugcccgccgccggcagcagcggaucccuggaaccgggcgaaaagccguacaagugcccggaauguggcaaaaguuuuagucgcagcgaucaucugaccacccaucagcguacccauaccggugagaagccauacaaaugcccagaaugugguaagagcuuuagcaccagcggcgagcugguucgucaccagcguacccacaccggcgagaagccguauaaguguccagaaugcgguaaaagcuuuagccgccgcgacgagcugaaugugcaucaacgcacccacacgggcgagaagccauauaagugcccggagugugguaagaguuucaguagcccagcggaucugacccgucaucaacguacgcacacgggcgagaaaccauacaaguguccggagugcggcaaaaguuuuagccgcagugaugaacuggugcgccaccagcgcacccauaccggcgaaaaaccguauaagugcccagagugcgguaagagcuucagccgcagcgacaaacuggugcgucaccagcgcacgcauacgggugagaaaccguacaagugcccggagugcggcaaaagcuucagcaccaccggcgcgcugaccgaacaucaacguacccauacgggugagaaaccaacgggcaaaaagaccagcgcuagcggcagcggcggcggcagcggcggcgacgcccuggacgacuucgaccuggacaugcugggcagcgacgcccuggacgacuucgaccuggacaugcugggcagcgacgcccuggacgacuucgaccuggacaugcugggcagcgacgcccuggacgacuucgaccuggacaugcugagcggcggccccaagaagaagcggaaggugggcagccaguaccugcccgacaccgacgaccggcaccggaucgaggagaagcggaagcggaccuacgagaccuucaagagcaucaugaagaaaucccccuucagcggccccaccgacccccggccccccccccggcggaucgccgugcccagccggagcagcgccagcgugcccaagcccgccccccagcccuaccccuucaccagcagccugagcaccaucaacuacgacgaguuccccaccaugguguuccccagcggccagaucagccaggccagcgcccuggcccccgcccccccccaggugcugccccaggcccccgcccccgcccccgcccccgccauggugagcgcccuggcccaggcccccgcccccgugcccgugcuggcccccggccccccccaggccguggccccccccgcccccaagcccacccaggccggcgagggcacccugagcgaggcccugcugcagcugcaguucgacgacgaggaccugggcgcccugcugggcaacagcaccgaccccgccguguucaccgaccuggccagcguggacaacagcgaguuccagcagcugcugaaccagggcauccccguggccccccacaccaccgagcccaugcugauggaguaccccgaggccaucacccggcuggugaccggcgcccagcggccccccgaccccgcccccgccccccugggcgcccccggccugcccaacggccugcugagcggcgacgaggacuucagcagcaucgccgacauggacuucagcgcccugcugggcagcggcagcggcagccgggacagccgggagggcauguuccugcccaagcccgaggccggcagcgccaucagcgacguguucgagggccgggaggugugccagcccaagcggcuccggcccuuccacccccccggcagccccugggccaaccggccccugcccgccagccuggcccccacccccaccggccccgugcacgagcccgugggcagccugacccccgcccccgugccccagccccuggaccccgcccccgccgugacccccgaggccagccaccugcuggaggaccccgacgaggagaccagccaggccgugaaggcccugcgggagauggccgacaccgugaucccccagaaggaggaggccgccaucugcggccagauggaccugagccacccccccccccggggccaccuggacgagcugaccaccacccuggagagcaugaccgaggaccugaaccuggacagcccccugacccccgagcugaacgagauccuggacaccuuccugaacgacgagugccugcugcacgccaugcacaucagcaccggccugagcaucuucgacaccagccuguucagcggcggcaagcggcccgccgccaccaagaaggccggccaggccaagaagaagaagggcagcuaccccuacgacgugcccgacuacgccugagcggccgcuuaauuaagcugccuucugcggggcuugccuucuggccaugcccuucuucucucccuugcaccuguaccucuuggucuuugaauaaagccugaguaggaagucuagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 130 - DNA, 21 bp, Homo sapiens
cttggggtgacaatggcttgg

SEQ ID NO: 131 - protein, 209 aa, Artificial Sequence
  source: /note="Description of Artificial Sequence: Synthetic polypeptide"
LEPGEKPYKCPECGKSFSRSDHLTTHQRTHTGEKPYKCPECGKSFSTSGELVRHQRTHTGEKPYKCPECGKSFSRRDELNVHQRTHTGEKPYKCPECGKSFSSPADLTRHQRTHTGEKPYKCPECGKSFSRSDELVRHQRTHTGEKPYKCPECGKSFSRSDKLVRHQRTHTGEKPYKCPECGKSFSTTGALTEHQRTHTGEKPTGKKTS

SEQ ID NO: 132 - protein, 800 aa, Artificial Sequence
  source: /note="Description of Artificial Sequence: Synthetic polypeptide"
MAPKKKRKVGIHGVPAAGSSGSLEPGEKPYKCPECGKSFSQSGNLTEHQRTHTGEKPYKCPECGKSFSHKNALQNHQRTHTGEKPYKCPECGKSFSQNSTLTEHQRTHTGEKPYKCPECGKSFSSKKHLAEHQRTHTGEKPYKCPECGKSFSTSGNLVRHQRTHTGEKPYKCPECGKSFSQSGHLTEHQRTHTPNPHRRTDPSHKPFQYKCPECGKSFSDKKDLTRHQRTHTGEKPTGKKTSASGSGGGSGGDALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRLRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFSGGKRPAATKKAGQAKKKKGSYPYDVPDYA

SEQ ID NO: 133 - RNA, 2644 nt, Artificial Sequence
  source: /note="Description of Artificial Sequence: Synthetic polynucleotide"
aggaaauaagagagaaaagaagaguaagaagaaauauaagagccaccauggcccccaagaagaagcggaaggugggcauccacggcgugcccgccgccggcagcagcggaucccucgaaccgggcgaaaagccauacaaauguccggaguguggcaagaguuucagccaaagcggcaaccucaccgagcaccagcgcacgcacaccggcgagaagccauauaaauguccagaaugcggcaagagcuucagccauaagaaugcgcugcagaaccaucagcgcacccacaccggugagaagccauacaagugcccagagugcggcaaaaguuucagccagaauagcacccucacggagcaucaacgcacgcauacgggugaaaagccguacaaaugcccagaauguggcaagagcuuuagcagcaagaaacaucuggcggagcaucagcguacccacacgggcgaaaagccauacaaauguccggaaugcggcaaaagcuucagcacgaguggcaaucuggugcgccaucaacguacgcacacgggugagaaaccguauaaaugcccagagugugguaaaagcuucagucagagcggccaucugaccgaacaccagcgcacccauacgccaaacccgcaucgccgcaccgauccgagccacaagccguuccaguacaaguguccagagugcgguaaaaguuuuagcgacaagaaggaucugacccgucaccaacguacccauaccggugaaaaaccaacgggcaagaaaaccagcgcuagcggcagcggcggcggcagcggcggcgacgcccuggacgacuucgaccuggacaugcugggcagcgacgcccuggacgacuucgaccuggacaugcugggcagcgacgcccuggacgacuucgaccuggacaugcugggcagcgacgcccuggacgacuucgaccuggacaugcugagcggcggccccaagaagaagcggaaggugggcagccaguaccugcccgacaccgacgaccggcaccggaucgaggagaagcggaagcggaccuacgagaccuucaagagcaucaugaagaaaucccccuucagcggccccaccgacccccggccccccccccggcggaucgccgugcccagccggagcagcgccagcgugcccaagcccgccccccagcccuaccccuucaccagcagccugagcaccaucaacuacgacgaguuccccaccaugguguuccccagcggccagaucagccaggccagcgcccuggcccccgcccccccccaggugcugccccaggcccccgcccccgcccccgcccccgccauggugagcgcccuggcccaggcccccgcccccgugcccgugcuggcccccggccccccccaggccguggccccccccgcccccaagcccacccaggccggcgagggcacccugagcgaggcccugcugcagcugcaguucgacgacgaggaccugggcgcccugcugggcaacagcaccgaccccgccguguucaccgaccuggccagcguggacaacagcgaguuccagcagcugcugaaccagggcauccccguggccccccacaccaccgagcccaugcugauggaguaccccgaggccaucacccggcuggugaccggcgcccagcggccccccgaccccgcccccgccccccugggcgcccccggccugcccaacggccugcugagcggcgacgaggacuucagcagcaucgccgacauggacuucagcgcccugcugggcagcggcagcggcagccgggacagccgggagggcauguuccugcccaagcccgaggccggcagcgccaucagcgacguguucgagggccgggaggugugccagcccaagcggcuccggcccuuccacccccccggcagccccugggccaaccggccccugcccgccagccuggcccccacccccaccggccccgugcacgagcccgugggcagccugacccccgcccccgugccccagccccuggaccccgcccccgccgugacccccgaggccagccaccugcuggaggaccccgacgaggagaccagccaggccgugaaggcccugcgggagauggccgacaccgugaucccccagaaggaggaggccgccaucugcggccagauggaccugagccacccccccccccggggccaccuggacgagcugaccaccacccuggagagcaugaccgaggaccugaaccuggacagcccccugacccccgagcugaacgagauccuggacaccuuccugaacgacgagugccugcugcacgccaugcacaucagcaccggccugagcaucuucgacaccagccuguucagcggcggcaagcggcccgccgccaccaagaaggccggccaggccaagaagaagaagggcagcuaccccuacgacgugcccgacuacgccugagcggccgcuuaauuaagcugccuucugcggggcuugccuucuggccaugcccuucuucucucccuugcaccuguaccucuuggucuuugaauaaagccugaguaggaagucuagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 134 - DNA, 23 bp, Homo sapiens
acctccgagatcccctaattcaa

SEQ ID NO: 135 - protein, 220 aa, Artificial Sequence
  source: /note="Description of Artificial Sequence: Synthetic polypeptide"
LEPGEKPYKCPECGKSFSQSGNLTEHQRTHTGEKPYKCPECGKSFSHKNALQNHQRTHTGEKPYKCPECGKSFSQNSTLTEHQRTHTGEKPYKCPECGKSFSSKKHLAEHQRTHTGEKPYKCPECGKSFSTSGNLVRHQRTHTGEKPYKCPECGKSFSQSGHLTEHQRTHTPNPHRRTDPSHKPFQYKCPECGKSFSDKKDLTRHQRTHTGEKPTGKKTS

SEQ ID NO: 136 - protein, 789 aa, Artificial Sequence
  source: /note="Description of Artificial Sequence: Synthetic polypeptide"
MAPKKKRKVGIHGVPAAGSSGSLEPGEKPYKCPECGKSFSQNSTLTEHQRTHTGEKPYKCPECGKSFSERSHLREHQRTHTGEKPYKCPECGKSFSSKKHLAEHQRTHTGEKPYKCPECGKSFSRNDTLTEHQRTHTGEKPYKCPECGKSFSDCRDLARHQRTHTGEKPYKCPECGKSFSQSGDLRRHQRTHTGEKPYKCPECGKSFSTKNSLTEHQRTHTGEKPTGKKTSASGSGGGSGGDALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRLRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFSGGKRPAATKKAGQAKKKKGSYPYDVPDYA

SEQ ID NO: 137 - RNA, 2611 nt, Artificial Sequence
  source: /note="Description of Artificial Sequence: Synthetic polynucleotide"
aggaaauaagagagaaaagaagaguaagaagaaauauaagagccaccauggcccccaagaagaagcggaaggugggcauccacggcgugcccgccgccggcagcagcggaucccuggagcccggcgagaagcccuacaaaugucccgaguguggcaaguccuucucccagaauagcacacugacagaacaccagaggacacacaccggcgagaaaccuuauaagugccccgaaugcggcaaaagcuuuuccgagaggagccaccugagggaacaccagagaacacacaccggagaaaaaccuuacaaaugccccgagugcggaaaguccuucagcagcaagaagcaccuggcugaacaccagagaacccacaccggcgagaagccuuacaagugccccgaauguggcaaaagcuucucuagaaacgacacacucaccgagcaccagagaacccacaccggcgaaaagccuuauaagugucccgaguguggcaagagcuucagcgauuguagagaucuggccagacaccaaaggacccacaccggagaaaaaccuuacaagugccccgaguguggaaagagcuuuagccaaagcggcgaucugaggagacaccagagaacacacaccggcgaaaaacccuauaagugucccgaaugcggaaaauccuucagcaccaaaaacucucugaccgagcaccaaagaacccacaccggcgaaaagccuaccggcaaaaagacaagcgcuagcggcagcggcggcggcagcggcggcgacgcccuggacgacuucgaccuggacaugcugggcagcgacgcccuggacgacuucgaccuggacaugcugggcagcgacgcccuggacgacuucgaccuggacaugcugggcagcgacgcccuggacgacuucgaccuggacaugcugagcggcggccccaagaagaagcggaaggugggcagccaguaccugcccgacaccgacgaccggcaccggaucgaggagaagcggaagcggaccuacgagaccuucaagagcaucaugaagaaaucccccuucagcggccccaccgacccccggccccccccccggcggaucgccgugcccagccggagcagcgccagcgugcccaagcccgccccccagcccuaccccuucaccagcagccugagcaccaucaacuacgacgaguuccccaccaugguguuccccagcggccagaucagccaggccagcgcccuggcccccgcccccccccaggugcugccccaggcccccgcccccgcccccgcccccgccauggugagcgcccuggcccaggcccccgcccccgugcccgugcuggcccccggccccccccaggccguggccccccccgcccccaagcccacccaggccggcgagggcacccugagcgaggcccugcugcagcugcaguucgacgacgaggaccugggcgcccugcugggcaacagcaccgaccccgccguguucaccgaccuggccagcguggacaacagcgaguuccagcagcugcugaaccagggcauccccguggccccccacaccaccgagcccaugcugauggaguaccccgaggccaucacccggcuggugaccggcgcccagcggccccccgaccccgcccccgccccccugggcgcccccggccugcccaacggccugcugagcggcgacgaggacuucagcagcaucgccgacauggacuucagcgcccugcugggcagcggcagcggcagccgggacagccgggagggcauguuccugcccaagcccgaggccggcagcgccaucagcgacguguucgagggccgggaggugugccagcccaagcggcuccggcccuuccacccccccggcagccccugggccaaccggccccugcccgccagccuggcccccacccccaccggccccgugcacgagcccgugggcagccugacccccgcccccgugccccagccccuggaccccgcccccgccgugacccccgaggccagccaccugcuggaggaccccgacgaggagaccagccaggccgugaaggcccugcgggagauggccgacaccgugaucccccagaaggaggaggccgccaucugcggccagauggaccugagccacccccccccccggggccaccuggacgagcugaccaccacccuggagagcaugaccgaggaccugaaccuggacagcccccugacccccgagcugaacgagauccuggacaccuuccugaacgacgagugccugcugcacgccaugcacaucagcaccggccugagcaucuucgacaccagccuguucagcggcggcaagcggcccgccgccaccaagaaggccggccaggccaagaagaagaagggcagcuaccccuacgacgugcccgacuacgccugagcggccgcuuaauuaagcugccuucugcggggcuugccuucuggccaugcccuucuucucucccuugcaccuguaccucuuggucuuugaauaaagccugaguaggaagucuagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 138 - DNA, 21 bp, Homo sapiens
cctgcagccccgcccagccta

SEQ ID NO: 139 - protein, 209 aa, Artificial Sequence
  source: /note="Description of Artificial Sequence: Synthetic polypeptide"
LEPGEKPYKCPECGKSFSQNSTLTEHQRTHTGEKPYKCPECGKSFSERSHLREHQRTHTGEKPYKCPECGKSFSSKKHLAEHQRTHTGEKPYKCPECGKSFSRNDTLTEHQRTHTGEKPYKCPECGKSFSDCRDLARHQRTHTGEKPYKCPECGKSFSQSGDLRRHQRTHTGEKPYKCPECGKSFSTKNSLTEHQRTHTGEKPTGKKTS

SEQ ID NO: 140 - protein, 789 aa, Artificial Sequence
  source: /note="Description of Artificial Sequence: Synthetic polypeptide"
MAPKKKRKVGIHGVPAAGSSGSLEPGEKPYKCPECGKSFSERSHLREHQRTHTGEKPYKCPECGKSFSRADNLTEHQRTHTGEKPYKCPECGKSFSRSDKLTEHQRTHTGEKPYKCPECGKSFSSKKHLAEHQRTHTGEKPYKCPECGKSFSTKNSLTEHQRTHTGEKPYKCPECGKSFSDKKDLTRHQRTHTGEKPYKCPECGKSFSSKKHLAEHQRTHTGEKPTGKKTSASGSGGGSGGDALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRLRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFSGGKRPAATKKAGQAKKKKGSYPYDVPDYA

SEQ ID NO: 141 - RNA, 2611 nt, Artificial Sequence
  source: /note="Description of Artificial Sequence: Synthetic polynucleotide"
aggaaauaagagagaaaagaagaguaagaagaaauauaagagccaccauggcccccaagaagaagcggaaggugggcauccacggcgugcccgccgccggcagcagcggaucccuggagcccggcgagaaacccuacaagugucccgaguguggcaagagcuuuuccgagagaagccaccugagggaacaccagagaacccacaccggcgagaagccuuacaaaugccccgaauguggaaagagcuuuucuagagccgacaaucugaccgaacaccaaagaacccacaccggcgaaaaacccuauaagugucccgaguguggaaaaagcuucucuagaagcgacaaacucacagagcaccagaggacacacaccggcgagaagcccuacaaaugucccgagugcggcaaaagcuucagcagcaagaagcaccuggccgagcaccaaagaacacacaccggcgaaaaaccuuauaaaugccccgagugcggcaaguccuuuuccaccaagaacucucugacagaacaccaaaggacacacaccggagaaaaacccuacaaaugucccgaauguggcaaauccuucagcgauaagaaggaccucaccagacaccagaggacacacaccggcgaaaaaccuuauaaaugucccgagugcggaaaguccuucuccagcaaaaagcaccucgcugagcaccaaaggacccacaccggcgagaagcccaccggaaaaaagaccagcgcuagcggcagcggcggcggcagcggcggcgacgcccuggacgacuucgaccuggacaugcugggcagcgacgcccuggacgacuucgaccuggacaugcugggcagcgacgcccuggacgacuucgaccuggacaugcugggcagcgacgcccuggacgacuucgaccuggacaugcugagcggcggccccaagaagaagcggaaggugggcagccaguaccugcccgacaccgacgaccggcaccggaucgaggagaagcggaagcggaccuacgagaccuucaagagcaucaugaagaaaucccccuucagcggccccaccgacccccggccccccccccggcggaucgccgugcccagccggagcagcgccagcgugcccaagcccgccccccagcccuaccccuucaccagcagccugagcaccaucaacuacgacgaguuccccaccaugguguuccccagcggccagaucagccaggccagcgcccuggcccccgcccccccccaggugcugccccaggcccccgcccccgcccccgcccccgccauggugagcgcccuggcccaggcccccgcccccgugcccgugcuggcccccggccccccccaggccguggccccccccgcccccaagcccacccaggccggcgagggcacccugagcgaggcccugcugcagcugcaguucgacgacgaggaccugggcgcccugcugggcaacagcaccgaccccgccguguucaccgaccuggccagcguggacaacagcgaguuccagcagcugcugaaccagggcauccccguggccccccacaccaccgagcccaugcugauggaguaccccgaggccaucacccggcuggugaccggcgcccagcggccccccgaccccgcccccgccccccugggcgcccccggccugcccaacggccugcugagcggcgacgaggacuucagcagcaucgccgacauggacuucagcgcccugcugggcagcggcagcggcagccgggacagccgggagggcauguuccugcccaagcccgaggccggcagcgccaucagcgacguguucgagggccgggaggugugccagcccaagcggcuccggcccuuccacccccccggcagccccugggccaaccggccccugcccgccagccuggcccccacccccaccggccccgugcacgagcccgugggcagccugacccccgcccccgugccccagccccuggaccccgcccccgccgugacccccgaggccagccaccugcuggaggaccccgacgaggagaccagccaggccgugaaggcccugcgggagauggccgacaccgugaucccccagaaggaggaggccgccaucugcggccagauggaccugagccacccccccccccggggccaccuggacgagcugaccaccacccuggagagcaugaccgaggaccugaaccuggacagcccccugacccccgagcugaacgagauccuggacaccuuccugaacgacgagugccugcugcacgccaugcacaucagcaccggccugagcaucuucgacaccagccuguucagcggcggcaagcggcccgccgccaccaagaaggccggccaggccaagaagaagaagggcagcuaccccuacgacgugcccgacuacgccugagcggccgcuuaauuaagcugccuucugcggggcuugccuucuggccaugcccuucuucucucccuugcaccuguaccucuuggucuuugaauaaagccugaguaggaagucuagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 142 - DNA, 21 bp, Homo sapiens
cccacccctccccggcagagc

SEQ ID NO: 143 - protein, 209 aa, Artificial Sequence
  source: /note="Description of Artificial Sequence: Synthetic polypeptide"
LEPGEKPYKCPECGKSFSERSHLREHQRTHTGEKPYKCPECGKSFSRADNLTEHQRTHTGEKPYKCPECGKSFSRSDKLTEHQRTHTGEKPYKCPECGKSFSSKKHLAEHQRTHTGEKPYKCPECGKSFSTKNSLTEHQRTHTGEKPYKCPECGKSFSDKKDLTRHQRTHTGEKPYKCPECGKSFSSKKHLAEHQRTHTGEKPTGKKTS

SEQ ID NO: 144 - protein, 789 aa, Artificial Sequence
  source: /note="Description of Artificial Sequence: Synthetic polypeptide"
MAPKKKRKVGIHGVPAAGSSGSLEPGEKPYKCPECGKSFSSKKHLAEHQRTHTGEKPYKCPECGKSFSTHLDLIRHQRTHTGEKPYKCPECGKSFSRKDNLKNHQRTHTGEKPYKCPECGKSFSDCRDLARHQRTHTGEKPYKCPECGKSFSREDNLHTHQRTHTGEKPYKCPECGKSFSDPGHLVRHQRTHTGEKPYKCPECGKSFSQLAHLRAHQRTHTGEKPTGKKTSASGSGGGSGGDALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRLRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFSGGKRPAATKKAGQAKKKKGSYPYDVPDYA

SEQ ID NO: 145 - RNA, 2611 nt, Artificial Sequence
  source: /note="Description of Artificial Sequence: Synthetic polynucleotide"
aggaaauaagagagaaaagaagaguaagaagaaauauaagagccaccauggcccccaagaagaagcggaaggugggcauccacggcgugcccgccgccggcagcagcggaucccuggagcccggcgaaaagcccuacaaaugucccgaauguggcaagagcuucagcagcaaaaagcaccuggcugaacaccagaggacccacaccggagagaaacccuauaaaugucccgaguguggaaaaagcuucagcacccaccucgaccucauuaggcaccaaagaacccacaccggcgaaaaacccuauaagugucccgaguguggaaaauccuuuucuagaaaggacaaucucaagaaucaccaaagaacacacaccggcgagaaaccuuacaagugucccgagugcggaaaguccuucuccgacuguagagaucuggcuagacaccagagaacccacaccggcgagaagcccuauaagugccccgagugcggcaaguccuucucuagagaggacaaucugcacacacaccagaggacccacaccggcgaaaaaccuuacaaaugccccgaguguggcaagagcuuuagcgaucccggacaccuggugagacaccaaagaacccacaccggcgagaagccuuacaagugucccgaauguggaaaauccuuuagccagcuggcccaccugagggcccaccaaaggacacacaccggcgaaaaacccaccggcaaaaagaccagcgcuagcggcagcggcggcggcagcggcggcgacgcccuggacgacuucgaccuggacaugcugggcagcgacgcccuggacgacuucgaccuggacaugcugggcagcgacgcccuggacgacuucgaccuggacaugcugggcagcgacgcccuggacgacuucgaccuggacaugcugagcggcggccccaagaagaagcggaaggugggcagccaguaccugcccgacaccgacgaccggcaccggaucgaggagaagcggaagcggaccuacgagaccuucaagagcaucaugaagaaaucccccuucagcggccccaccgacccccggccccccccccggcggaucgccgugcccagccggagcagcgccagcgugcccaagcccgccccccagcccuaccccuucaccagcagccugagcaccaucaacuacgacgaguuccccaccaugguguuccccagcggccagaucagccaggccagcgcccuggcccccgcccccccccaggugcugccccaggcccccgcccccgcccccgcccccgccauggugagcgcccuggcccaggcccccgcccccgugcccgugcuggcccccggccccccccaggccguggccccccccgcccccaagcccacccaggccggcgagggcacccugagcgaggcccugcugcagcugcaguucgacgacgaggaccugggcgcccugcugggcaacagcaccgaccccgccguguucaccgaccuggccagcguggacaacagcgaguuccagcagcugcugaaccagggcauccccguggccccccacaccaccgagcccaugcugauggaguaccccgaggccaucacccggcuggugaccggcgcccagcggccccccgaccccgcccccgccccccugggcgcccccggccugcccaacggccugcugagcggcgacgaggacuucagcagcaucgccgacauggacuucagcgcccugcugggcagcggcagcggcagccgggacagccgggagggcauguuccugcccaagcccgaggccggcagcgccaucagcgacguguucgagggccgggaggugugccagcccaagcggcuccggcccuuccacccccccggcagccccugggccaaccggccccugcccgccagccuggcccccacccccaccggccccgugcacgagcccgugggcagccugacccccgcccccgugccccagccccuggaccccgcccccgccgugacccccgaggccagccaccugcuggaggaccccgacgaggagaccagccaggccgugaaggcccugcgggagauggccgacaccgugaucccccagaaggaggaggccgccaucugcggccagauggaccugagccacccccccccccggggccaccuggacgagcugaccaccacccuggagagcaugaccgaggaccugaaccuggacagcccccugacccccgagcugaacgagauccuggacaccuuccugaacgacgagugccugcugcacgccaugcacaucagcaccggccugagcaucuucgacaccagccuguucagcggcggcaagcggcccgccgccaccaagaaggccggccaggccaagaagaagaagggcagcuaccccuacgacgugcccgacuacgccugagcggccgcuuaauuaagcugccuucugcggggcuugccuucuggccaugcccuucuucucucccuugcaccuguaccucuuggucuuugaauaaagccugaguaggaagucuagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 146 - DNA, 21 bp, Homo sapiens
agaggctaggccaagactccc

SEQ ID NO: 147 - protein, 209 aa, Artificial Sequence
  source: /note="Description of Artificial Sequence: Synthetic polypeptide"
LEPGEKPYKCPECGKSFSSKKHLAEHQRTHTGEKPYKCPECGKSFSTHLDLIRHQRTHTGEKPYKCPECGKSFSRKDNLKNHQRTHTGEKPYKCPECGKSFSDCRDLARHQRTHTGEKPYKCPECGKSFSREDNLHTHQRTHTGEKPYKCPECGKSFSDPGHLVRHQRTHTGEKPYKCPECGKSFSQLAHLRAHQRTHTGEKPTGKKTS

SEQ ID NO: 148 - protein, 789 aa, Artificial Sequence
  source: /note="Description of Artificial Sequence: Synthetic polypeptide"
MAPKKKRKVGIHGVPAAGSSGSLEPGEKPYKCPECGKSFSRSDKLVRHQRTHTGEKPYKCPECGKSFSQSGDLRRHQRTHTGEKPYKCPECGKSFSTSGELVRHQRTHTGEKPYKCPECGKSFSRSDKLVRHQRTHTGEKPYKCPECGKSFSDPGHLVRHQRTHTGEKPYKCPECGKSFSRNDALTEHQRTHTGEKPYKCPECGKSFSRSDHLTNHQRTHTGEKPTGKKTSASGSGGGSGGDALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRLRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFSGGKRPAATKKAGQAKKKKGSYPYDVPDYA

SEQ ID NO: 149 - RNA, 2611 nt, Artificial Sequence
  source: /note="Description of Artificial Sequence: Synthetic polynucleotide"
aggaaauaagagagaaaagaagaguaagaagaaauauaagagccaccauggcccccaagaagaagcggaaggugggcauccacggcgugcccgccgccggcagcagcggaucccuggagcccggcgaaaagcccuauaagugccccgagugcggcaagagcuucucuagaagcgacaaacucgugagacaccagagaacacacaccggagagaaaccuuacaagugccccgaguguggcaaguccuucucccaauccggcgaucugaggagacaccagagaacccacaccggcgaaaaacccuacaaaugccccgagugcggaaaguccuuuuccaccuccggcgagcucgugagacaccaaaggacccacaccggcgagaagccuuacaagugccccgagugcggcaaauccuucuccagauccgacaagcucgugaggcaccagaggacacacaccggagagaaaccuuauaagugucccgaauguggaaaguccuucagcgaccccggacaccuggugagacaccagaggacccacaccggcgaaaagccuuauaaaugucccgagugcggaaaaagcuuuucuagaaacgaugcucugacagagcaccaaagaacccacaccggcgaaaaacccuacaagugucccgagugcggaaagagcuucagcagaagcgaccaccugaccaaccaccagagaacacacaccggagaaaaacccaccggcaaaaagaccuccgcuagcggcagcggcggcggcagcggcggcgacgcccuggacgacuucgaccuggacaugcugggcagcgacgcccuggacgacuucgaccuggacaugcugggcagcgacgcccuggacgacuucgaccuggacaugcugggcagcgacgcccuggacgacuucgaccuggacaugcugagcggcggccccaagaagaagcggaaggugggcagccaguaccugcccgacaccgacgaccggcaccggaucgaggagaagcggaagcggaccuacgagaccuucaagagcaucaugaagaaaucccccuucagcggccccaccgacccccggccccccccccggcggaucgccgugcccagccggagcagcgccagcgugcccaagcccgccccccagcccuaccccuucaccagcagccugagcaccaucaacuacgacgaguuccccaccaugguguuccccagcggccagaucagccaggccagcgcccuggcccccgcccccccccaggugcugccccaggcccccgcccccgcccccgcccccgccauggugagcgcccuggcccaggcccccgcccccgugcccgugcuggcccccggccccccccaggccguggccccccccgcccccaagcccacccaggccggcgagggcacccugagcgaggcccugcugcagcugcaguucgacgacgaggaccugggcgcccugcugggcaacagcaccgaccccgccguguucaccgaccuggccagcguggacaacagcgaguuccagcagcugcugaaccagggcauccccguggccccccacaccaccgagcccaugcugauggaguaccccgaggccaucacccggcuggugaccggcgcccagcggccccccgaccccgcccccgccccccugggcgcccccggccugcccaacggccugcugagcggcgacgaggacuucagcagcaucgccgacauggacuucagcgcccugcugggcagcggcagcggcagccgggacagccgggagggcauguuccugcccaagcccgaggccggcagcgccaucagcgacguguucgagggccgggaggugugccagcccaagcggcuccggcccuuccacccccccggcagccccugggccaaccggccccugcccgccagccuggcccccacccccaccggccccgugcacgagcccgugggcagccugacccccgcccccgugccccagccccuggaccccgcccccgccgugacccccgaggccagccaccugcuggaggaccccgacgaggagaccagccaggccgugaaggcccugcgggagauggccgacaccgugaucccccagaaggaggaggccgccaucugcggccagauggaccugagccacccccccccccggggccaccuggacgagcugaccaccacccuggagagcaugaccgaggaccugaaccuggacagcccccugacccccgagcugaacgagauccuggacaccuuccugaacgacgagugccugcugcacgccaugcacaucagcaccggccugagcaucuucgacaccagccuguucagcggcggcaagcggcccgccgccaccaagaaggccggccaggccaagaagaagaagggcagcuaccccuacgacgugcccgacuacgccugagcggccgcuuaauuaagcugccuucugcggggcuugccuucuggccaugcccuucuucucucccuugcaccuguaccucuuggucuuugaauaaagccugaguaggaagucuagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 150 - DNA, 21 bp, Homo sapiens
aggctgggcggggctgcaggg

SEQ ID NO: 151 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSQSGDLRRHQRTHTGEKPYKCPECGKSFSTSGELVRHQRTHTGEKPYKCPECGKSFSRSDKLVRHQRTHTGEKPYKCPECGKSFSDPGHLVRHQRTHTGEKPYKCPECGKSFSRNDALTEHQRTHTGEKPYKCPECGKSFSRSDHLTNHQRTHTGEKPTGKKTS

SEQ ID NO: 152 - protein, 789 aa, Artificial Sequence
  source: /note="Description of Artificial Sequence: Synthetic polypeptide"
MAPKKKRKVGIHGVPAAGSSGSLEPGEKPYKCPECGKSFSTSGHLVRHQRTHTGEKPYKCPECGKSFSTTGNLTVHQRTHTGEKPYKCPECGKSFSTSGSLVRHQRTHTGEKPYKCPECGKSFSRSDKLVRHQRTHTGEKPYKCPECGKSFSRSDELVRHQRTHTGEKPYKCPECGKSFSRSDKLVRHQRTHTGEKPYKCPECGKSFSQRAHLERHQRTHTGEKPTGKKTSASGSGGGSGGDALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRLRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFSGGKRPAATKKAGQAKKKKGSYPYDVPDYA

SEQ ID NO: 153 - RNA, 2611 nt, Artificial Sequence
  source: /note="Description of Artificial Sequence: Synthetic polynucleotide"
aggaaauaagagagaaaagaagaguaagaagaaauauaagagccaccauggcccccaagaagaagcggaaggugggcauccacggcgugcccgccgccggcagcagcggaucccuggagcccggcgaaaagcccuacaaaugucccgaaugcggcaaauccuucuccaccuccggccaccucgugagacaccagaggacacacaccggcgagaagccuuauaagugccccgaaugcggcaaaagcuucuccaccaccggcaaucugaccguccaccagagaacacacaccggcgaaaaaccuuauaagugucccgaguguggcaaauccuuuuccaccagcggaucucuggugagacaccaaaggacacacaccggcgaaaaacccuacaaaugccccgaguguggaaaauccuucucuagaagcgacaagcuggugagacaccagaggacccacaccggcgagaaacccuacaagugccccgaauguggcaagagcuucucuagauccgacgagcucgugagacaccaaagaacccacaccggcgaaaagccuuacaaaugucccgagugcggaaagagcuuuagcagaagcgauaagcuggucagacaccaaagaacacacaccggagaaaaacccuauaagugccccgaguguggcaaguccuuuagccagagagcccaccuggagagacaccaaagaacccacaccggcgaaaaacccaccggaaaaaagacaagcgcuagcggcagcggcggcggcagcggcggcgacgcccuggacgacuucgaccuggacaugcugggcagcgacgcccuggacgacuucgaccuggacaugcugggcagcgacgcccuggacgacuucgaccuggacaugcugggcagcgacgcccuggacgacuucgaccuggacaugcugagcggcggccccaagaagaagcggaaggugggcagccaguaccugcccgacaccgacgaccggcaccggaucgaggagaagcggaagcggaccuacgagaccuucaagagcaucaugaagaaaucccccuucagcggccccaccgacccccggccccccccccggcggaucgccgugcccagccggagcagcgccagcgugcccaagcccgccccccagcccuaccccuucaccagcagccugagcaccaucaacuacgacgaguuccccaccaugguguuccccagcggccagaucagccaggccagcgcccuggcccccgcccccccccaggugcugccccaggcccccgcccccgcccccgcccccgccauggugagcgcccuggcccaggcccccgcccccgugcccgugcuggcccccggccccccccaggccguggccccccccgcccccaagcccacccaggccggcgagggcacccugagcgaggcccugcugcagcugcaguucgacgacgaggaccugggcgcccugcugggcaacagcaccgaccccgccguguucaccgaccuggccagcguggacaacagcgaguuccagcagcugcugaaccagggcauccccguggccccccacaccaccgagcccaugcugauggaguaccccgaggccaucacccggcuggugaccggcgcccagcggccccccgaccccgcccccgccccccugggcgcccccggccugcccaacggccugcugagcggcgacgaggacuucagcagcaucgccgacauggacuucagcgcccugcugggcagcggcagcggcagccgggacagccgggagggcauguuccugcccaagcccgaggccggcagcgccaucagcgacguguucgagggccgggaggugugccagcccaagcggcuccggcccuuccacccccccggcagccccugggccaaccggccccugcccgccagccuggcccccacccccaccggccccgugcacgagcccgugggcagccugacccccgcccccgugccccagccccuggaccccgcccccgccgugacccccgaggccagccaccugcuggaggaccccgacgaggagaccagccaggccgugaaggcccugcgggagauggccgacaccgugaucccccagaaggaggaggccgccaucugcggccagauggaccugagccacccccccccccggggccaccuggacgagcugaccaccacccuggagagcaugaccgaggaccugaaccuggacagcccccugacccccgagcugaacgagauccuggacaccuuccugaacgacgagugccugcugcacgccaugcacaucagcaccggccugagcaucuucgacaccagccuguucagcggcggcaagcggcccgccgccaccaagaaggccggccaggccaagaagaagaagggcagcuaccccuacgacgugcccgacuacgccugagcggccgcuuaauuaagcugccuucugcggggcuugccuucuggccaugcccuucuucucucccuugcaccuguaccucuuggucuuugaauaaagccugaguaggaagucuagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 154 - DNA, 21 bp, Homo sapiens
ggaggggtgggggttaatggt

SEQ ID NO: 155 - protein, 209 aa, Artificial Sequence
  source: /note="Description of Artificial Sequence: Synthetic polypeptide"
LEPGEKPYKCPECGKSFSTSGHLVRHQRTHTGEKPYKCPECGKSFSTTGNLTVHQRTHTGEKPYKCPECGKSFSTSGSLVRHQRTHTGEKPYKCPECGKSFSRSDKLVRHQRTHTGEKPYKCPECGKSFSRSDELVRHQRTHTGEKPYKCPECGKSFSRSDKLVRHQRTHTGEKPYKCPECGKSFSQRAHLERHQRTHTGEKPTGKKTS

SEQ ID NO: 156 - protein, 789 aa, Artificial Sequence
  source: /note="Description of Artificial Sequence: Synthetic polypeptide"
MAPKKKRKVGIHGVPAAGSSGSLEPGEKPYKCPECGKSFSRNDTLTEHQRTHTGEKPYKCPECGKSFSRNDALTEHQRTHTGEKPYKCPECGKSFSTSGELVRHQRTHTGEKPYKCPECGKSFSRSDNLVRHQRTHTGEKPYKCPECGKSFSRSDELVRHQRTHTGEKPYKCPECGKSFSRSDKLVRHQRTHTGEKPYKCPECGKSFSQSSNLVRHQRTHTGEKPTGKKTSASGSGGGSGGDALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRLRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFSGGKRPAATKKAGQAKKKKGSYPYDVPDYA

SEQ ID NO: 157 - RNA, 2611 nt, Artificial Sequence
  source: /note="Description of Artificial Sequence: Synthetic polynucleotide"
aggaaauaagagagaaaagaagaguaagaagaaauauaagagccaccauggcccccaagaagaagcggaaggugggcauccacggcgugcccgccgccggcagcagcggaucccuggagcccggcgagaagcccuacaaaugucccgaauguggcaagagcuucucuagaaacgacacacugaccgaacaccagagaacacacaccggcgaaaaaccuuauaaaugucccgaguguggaaaauccuucucuagaaaugacgcucucaccgagcaccaaagaacacacaccggcgaaaagccuuacaaaugccccgaauguggaaaguccuucuccaccuccggagagcuggugagacaccagagaacccacaccggcgaaaaacccuacaagugccccgagugcggaaaaagcuucucuagaagcgauaaucuggugagacaccaaaggacacacaccggcgagaagcccuauaagugucccgaaugcggcaaguccuuuuccagaagcgacgaacuggugagacaccagagaacccacaccggagagaagccuuauaagugucccgagugcggaaagagcuuuucuagauccgacaagcucgugagacaccaaaggacccacaccggcgagaaacccuauaaaugucccgaguguggcaaauccuuuucccagagcagcaaccucgugaggcaccagaggacccacaccggcgagaaacccaccggcaaaaagaccagcgcuagcggcagcggcggcggcagcggcggcgacgcccuggacgacuucgaccuggacaugcugggcagcgacgcccuggacgacuucgaccuggacaugcugggcagcgacgcccuggacgacuucgaccuggacaugcugggcagcgacgcccuggacgacuucgaccuggacaugcugagcggcggccccaagaagaagcggaaggugggcagccaguaccugcccgacaccgacgaccggcaccggaucgaggagaagcggaagcggaccuacgagaccuucaagagcaucaugaagaaaucccccuucagcggccccaccgacccccggccccccccccggcggaucgccgugcccagccggagcagcgccagcgugcccaagcccgccccccagcccuaccccuucaccagcagccugagcaccaucaacuacgacgaguuccccaccaugguguuccccagcggccagaucagccaggccagcgcccuggcccccgcccccccccaggugcugccccaggcccccgcccccgcccccgcccccgccauggugagcgcccuggcccaggcccccgcccccgugcccgugcuggcccccggccccccccaggccguggccccccccgcccccaagcccacccaggccggcgagggcacccugagcgaggcccugcugcagcugcaguucgacgacgaggaccugggcgcccugcugggcaacagcaccgaccccgccguguucaccgaccuggccagcguggacaacagcgaguuccagcagcugcugaaccagggcauccccguggccccccacaccaccgagcccaugcugauggaguaccccgaggccaucacccggcuggugaccggcgcccagcggccccccgaccccgcccccgccccccugggcgcccccggccugcccaacggccugcugagcggcgacgaggacuucagcagcaucgccgacauggacuucagcgcccugcugggcagcggcagcggcagccgggacagccgggagggcauguuccugcccaagcccgaggccggcagcgccaucagcgacguguucgagggccgggaggugugccagcccaagcggcuccggcccuuccacccccccggcagccccugggccaaccggccccugcccgccagccuggcccccacccccaccggccccgugcacgagcccgugggcagccugacccccgcccccgugccccagccccuggaccccgcccccgccgugacccccgaggccagccaccugcuggaggaccccgacgaggagaccagccaggccgugaaggcccugcgggagauggccgacaccgugaucccccagaaggaggaggccgccaucugcggccagauggaccugagccacccccccccccggggccaccuggacgagcugaccaccacccuggagagcaugaccgaggaccugaaccuggacagcccccugacccccgagcugaacgagauccuggacaccuuccugaacgacgagugccugcugcacgccaugcacaucagcaccggccugagcaucuucgacaccagccuguucagcggcggcaagcggcccgccgccaccaagaaggccggccaggccaagaagaagaagggcagcuaccccuacgacgugcccgacuacgccugagcggccgcuuaauuaagcugccuucugcggggcuugccuucuggccaugcccuucuucucucccuugcaccuguaccucuuggucuuugaauaaagccugaguaggaagucuagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 158 - DNA, 21 bp, Homo sapiens
gaaggggtggaggctctgccg

SEQ ID NO: 159 - protein, 209 aa, Artificial Sequence
  source: /note="Description of Artificial Sequence: Synthetic polypeptide"
LEPGEKPYKCPECGKSFSRNDTLTEHQRTHTGEKPYKCPECGKSFSRNDALTEHQRTHTGEKPYKCPECGKSFSTSGELVRHQRTHTGEKPYKCPECGKSFSRSDNLVRHQRTHTGEKPYKCPECGKSFSRSDELVRHQRTHTGEKPYKCPECGKSFSRSDKLVRHQRTHTGEKPYKCPECGKSFSQSSNLVRHQRTHTGEKPTGKKTS

SEQ ID NO: 160 - RNA, 2645 nt, Artificial Sequence
  source: /note="Description of Artificial Sequence: Synthetic polynucleotide"
aggaaauaagagagaaaagaagaguaagaagaaauauaagagccaccauggccccgaagaaaaagcgcaaagucggaauccauggugucccugcggcuggaaguuccggcuccuuggaaccgggagagaagccuuauaaguguccggagugugggaagucguucuccaccucgggcaaccucaccgaacaucagcgcacacauacgggggagaaaccuuacaaaugcccggaauguggaaagagcuucuccgauucgggaaaucucagagugcaccaacgcacccacacaggagaaaaaccguauaagugccccgaaugcgggaaaucguucucccacaagaaugcgcugcagaaccaccagaggacacauacuggggagaagcccuacaaguguccugaaugcggaaaguccuucucgcgcaacgauacuuugaccgagcaccagcgcacucacaccggcgaaaagccguacaagugcccagagugcgguaaaagcuucucgcaacgggcccaucuggaacggcaccagcggacucacacuggagaaaagcccuacaagugucccgagugcgggaaguccuuuucccgguccgauaagcucgugcgccaccagagaacccauacuggagagaaaccguacaaauguccagaaugcggcaaauccuucucggacccgggacaccucgugcggcaucaacggacccauaccggggaaaagcccaccggaaagaaaacuagcgcgucaggcucugguggaggaucggggggagaugcucuggacgacuuugaccuugacaugcuuggcuccgacgcccuugacgacuucgaccucgauaugcugggaucggacgcccuggaugacuucgaucuggacauguugggcucggacgcgcuagacgauuuugaccuggauaugcuguccggaggucccaagaagaagcggaaggucggcagccaguaucugccggauacugaugaccggcacagaaucgaggagaagcgaaagcggaccuacgaaacuuucaagagcauuaugaagaaguccccguucucggguccaaccgaccccagaccuccuccgcggagaauugccgugccaagccgcucaagcgccagcgugcccaagccagcaccacagcccuacccguucaccuccucccuuucgaccaucaacuacgacgaauucccaaccaugguguucccuagcggacaaaucagccaggcuuccgcucuggcaccagccccaccucaagugcucccgcaagcgccugcuccagcaccggcuccugccaugguuucagcgcuggcccaagcacccgcuccugugccugugcuggccccuggaccaccacaagcaguagccccgccugcaccuaagccaacucaggccggcgaaggaacccugagcgaagcguugcugcagcuucaguucgacgacgaggaccugggugcccuguugggcaacucaacugacccugccguguucaccgaccuggcauccgucgauaacuccgaguuccagcaguugcugaaccagggaaucccagucgccccccauaccaccgaaccgaugcucauggaguaccccgaagccaucaccagacuggucaccggcgcacaaaggcccccugauccugcucccgcaccucucggugccccuggacugccaaacggccuucuguccggcgacgaggacuucucguccaucgccgauauggauuucuccgcccugcucggauccggcagcggaucacgcgacucgcgcgaagggauguuccugccgaagccugaggcugguuccgccauuagcgacguguucgaggggcgcgaagucugccaacccaagagacugcgcccguuucaucccccgggaagcccuugggccaacagaccucugccagccucccuggcacccacuccgacugggccugugcacgaacccgugggcucccugacuccggcaccagugccacagccccuggauccagccccugcugugaccccggaggccucacaccuucuggaagauccggacgaggaaacgucccaggccgugaaggcccugcgggagauggcggacacugugaucccucagaaagaagaggcggccauuugcggccagauggaccucucccauccgccuccgagaggacaccuggaugaacucacgaccacccucgaguccaugaccgaggaccugaaccuggacuccccccugacacccgaacucaacgagauccuggacaccuuccugaacgacgagugccugcuccacgccaugcacaucucaaccgggcugucgaucuucgacacuagcuuguucucuggaggaaagaggccggccgcuacuaagaaggccggacaagcgaagaagaagaagggaucguacccuuacgacgugcccgacuacgcaugagcggccgcuuaauuaagcugccuucugcggggcuugccuucuggccaugcccuucuucucucccuugcaccuguaccucuuggucuuugaauaaagccugaguaggaagucuagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 161 - RNA, 2645 nt, Artificial Sequence
  source: /note="Description of Artificial Sequence: Synthetic polynucleotide"
aggaaauaagagagaaaagaagaguaagaagaaauauaagagccaccauggccccgaagaagaagcggaaggucggcauccacggagugccggcagcagggucaucaggcucccucgaacccggggaaaagccguacaaguguccggagugugggaagucauucuccacuuccgggaaucugaccgagcaucaacgcacccacacuggcgagaagcccuacaaaugcccggagugcggaaaaucguucucggacuccgggaaccuucggguccaccaaaggacucauaccggggagaaaccguacaaaugucccgaaugcgggaagucguucagccauaagaacgcgcugcagaaccaucagaggacccauacuggagaaaagcccuauaaguguccggaaugcggaaagucguucucacgcaacgacacccucaccgaacaccagcgcacucacaccggagagaagccuuacaagugcccggaauguggaaagagcuucagccagcgggcacaucuggaaagacaccagcgaacccacaccggggaaaaaccguauaagugccccgaguguggaaaguccuuuucacgguccgauaagcucgugcgccaccagagaacucacacuggggagaagccguacaagugucccgagugcggcaagagcuucucagauccgggacaccuugugcgacaucaacggacccauaccggagaaaaaccgaccgggaaaaagaccucagcaucaggcucaggaggcggaucaggaggcgacgcgcucgaugacuucgaucuggacauguugggguccgacgcgcuugacgacuucgaccuugauaugcucggauccgacgcccucgacgauuuugaucucgacaugcuugggucagacgcccuggacgauuucgaccuggacaugcuguccgguggaccgaaaaagaagaggaaggucgggucccaguaccucccggacaccgaugaccgacaccggauugaagagaagcgcaagagaaccuacgaaaccuucaagucgauuaugaagaagucgccguucucgggaccgacugaucccagaccgccgcccagaaggauugccgugccgucgaggucaagcgccucagugccgaaacccgcuccgcaaccguaccccuucaccucaucacuuuccaccaucaacuacgaugaguuccccaccaugguguucccguccggccagaucucacaggccucagcccuugcaccggcaccgccccaaguccuuccgcaagcacccgcacccgcucccgcuccggcaaugguguccgcgcucgcacaagcaccggcuccggugccggucuuggcuccgggaccgccgcaagcaguggcaccacccgcuccgaaaccgacucaggcuggggagggaacccuguccgaagcccugcugcaacuucaauucgacgaugaagaucugggcgcacuguugggaaacuccacugauccggcaguguucaccgaucuggccucgguggacaacuccgaguuccagcagcugcucaaccaagggauuccggucgccccgcauacuaccgagcccaugcugauggaauacccggaagcaaucacccggcuggucacuggugcacaaagaccccccgauccugcuccggcaccguugggagcaccgggguugcccaaugggcugcuuucgggggacgaggauuucucgucaauugccgacauggacuucucggcccuguugggauccggaagcggaagcagggacucacgagagggaauguuccuaccgaagcccgaagcgggaucagcaaucucagacguguuugaaggccgcgaagucugccagccgaagcgccuucgcccguuccauccgccgggaucacccugggccaacagaccccugccggcaucacuggccccgacuccgacugguccggugcacgaaccggucgggagccugacuccggcacccgugccccaaccguuggauccggcaccggcagugacuccggaagcuucccaccuccuggaggauccggacgaagagacuucgcaggcagugaaggcccugcgcgaaauggcggacaccgugauuccccagaaggaagaggcagcgaucugcgggcagauggaccugucacauccgcccccgagaggacaccuggacgagcugaccacuacccuggaaucgaugacugaagaucugaaccuggacucaccgcugacucccgagcugaacgaaauccuggacaccuuccugaacgacgagugccuucuccacgccaugcauaucuccaccgggcugagcaucuucgacaccucgcuguucucgggaggaaaacgcccggccgcaacuaagaaggccggacaggccaagaagaagaaggggucauacccguacgacgugcccgacuaugcgugagcggccgcuuaauuaagcugccuucugcggggcuugccuucuggccaugcccuucuucucucccuugcaccuguaccucuuggucuuugaauaaagccugaguaggaagucuagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 162 - RNA, 2645 nt, Artificial Sequence
  source: /note="Description of Artificial Sequence: Synthetic polynucleotide"
aggaaauaagagagaaaagaagaguaagaagaaauauaagagccaccauggcccccaagaagaagcgcaaggucgggauccacggagucccggcagcaggauccucaggcucacuggaaccgggggaaaaacccuacaagugcccggaaugcggcaagagcuucucgaccuccgggaaccugaccgagcaccagcgcacccacaccggagagaaaccguacaagugccccgaaugcgggaaaucguucucagacucgggaaaccucagggugcaccagcggacccacacgggggaaaagccguacaaaugcccggagugcgggaagucauucucccacaagaacgcgcugcagaaccaccaaagaacccacaccggcgaaaaaccguacaagugccccgagugcggaaaguccuucucccgcaacgacacccucaccgaacaccaacgcacccacaccggagaaaagcccuacaagugcccggaaugcggaaagagcuucagccagagggcccaccuggaaagacaccagagaacccacaccggcgaaaagccguacaaaugcccggagugcgggaaguccuucagccggucagacaagcugguccgccaccaaaggacccacacaggagaaaagcccuacaagugcccggaaugcggaaaaucguucagcgaccccggacaccugguccggcaccagaggacccacaccggggagaagccgaccggcaaaaagaccucagcgagcggauccggaggaggaucagggggggacgcacuggacgacuucgaccuggacaugcugggauccgacgcacuggacgacuucgaccuagacaugcucggaucggacgcacucgacgacuucgaccucgacaugcuaggaucagacgcacuagacgacuucgaccucgacaugcugucgggaggaccgaagaaaaagcggaaggucggaucacaguaccucccggacaccgacgacaggcacagaaucgaagaaaaacgcaagcgcaccuacgaaaccuucaagagcaucaugaaaaagucgccguucucaggaccgaccgaccccagaccgccaccgaggagaauagccgucccgagccgauccuccgcauccgugccgaaaccggcaccgcaacccuacccguucaccucgucccugucgaccaucaacuacgacgaguuccccaccaugguguuccccuccgggcagaucucacaggccucggcacuggcacccgcaccaccgcaagugcugccccaagcaccggcacccgcaccggcgcccgcaauggugucagcgcuggcacaggcaccagcaccggugccaguccucgcaccgggaccgccgcaagcaguggcaccgccggcaccgaaaccgacccaggccggagaagggacccuguccgaggcgcugcugcaacuccaguucgacgacgaggaccugggagcacuccugggaaacuccaccgacccggcaguguucaccgaccucgcaucgguggacaacuccgaguuccaacagcuccugaaccaggggauaccgguggcaccgcacaccaccgaaccgaugcugauggaauacccggaagccaucacccggcucgugaccggagcgcaaagaccgcccgaccccgcgcccgcaccgcugggagcaccgggacuaccgaacgggcugcucucaggggacgaggacuucuccagcaucgcagacauggacuucuccgcccugcugggaucaggauccggaucacgcgacucccgggaaggaauguuccugccgaagccggaagcaggcagcgcaaucuccgacguguucgaaggccgcgaggucugccagcccaagcgccugcgaccguuccacccgccgggaucaccgugggcaaaccgcccgcuaccggcaucacuggcaccgacacccaccggaccggugcacgaaccggucgggucacugacccccgcaccggucccgcaaccgcuagacccggcaccggcagugaccccggaagcaucgcaccuccuggaggacccggacgaggaaaccucacaggcagugaaggcccugcgggagauggccgacaccgugauaccgcagaaggaggaggccgccaucugcggacaaauggaccugucacacccgcccccgagaggacaccuggacgaacucaccaccacccuggagagcaugaccgaggaccugaaccuggacucaccgcugaccccggagcugaacgaaauccuggacaccuuccugaacgacgagugccugcugcacgcaaugcacaucagcaccgggcugucgaucuucgacaccagccuguucuccggagggaaaagacccgccgccaccaagaaagcgggccaagcaaagaaaaagaagggaucguaccccuacgacgugccggacuacgcaugagcggccgcuuaauuaagcugccuucugcggggcuugccuucuggccaugcccuucuucucucccuugcaccuguaccucuuggucuuugaauaaagccugaguaggaagucuagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 163 - RNA, 2645 nt, Artificial Sequence
  source: /note="Description of Artificial Sequence: Synthetic polynucleotide"
aggaaauaagagagaaaagaagaguaagaagaaauauaagagccaccauggccccgaagaaaaagaggaaggucgggauccacggagucccagccgcaggaagcagcggaagccuggaacccggagaaaaacccuacaagugcccagaaugcggcaagagcuucagcaccagcggaaaccugaccgaacaccagcggacgcacacaggggagaaaccguacaaaugcccggagugcggaaagagcuucagcgacagcggcaaccuccgcgugcaccagagaacccacacgggagagaagccguacaagugcccggaaugcggaaaaagcuucagccacaagaacgcgcugcagaaccaccagaggacacacacgggcgagaagcccuacaaaugccccgaaugcgggaaaagcuucagccggaacgacacccucaccgagcaccagcgaacccacaccggagaaaagccguacaagugcccggaaugcggaaaaagcuucagccaacgggcccaccuggaacgccaccaaaggacccacacaggagaaaagcccuacaagugcccagagugcggcaaaagcuucagccggagcgacaagcugguccggcaccagcgcacacacaccggcgaaaagccauacaagugccccgagugcggaaagagcuucagcgacccaggacaccucgugcggcaccaacgcacgcacaccggggaaaaaccgaccggaaaaaagaccagcgcgagcggaagcggaggaggaagcggaggcgacgcccuggacgacuucgaccuggacaugcuggggagcgacgcacuggacgacuucgaccuggacaugcugggaagcgacgcgcuggacgacuucgaccuggacaugcugggcagcgacgcccucgacgacuucgaccucgacaugcugagcggcggacccaagaagaagagaaaggucggaagccaguaccucccggacaccgacgacaggcaccgcaucgaagagaagcggaaaagaaccuacgaaaccuucaagagcaucaugaaaaagagcccguucagcggaccaaccgaccccagaccaccaccgagaagaaucgcggucccaagcaggagcagcgccagcgucccgaagccagccccacagccguaccccuucaccagcagccugagcaccaucaacuacgacgaguuccccaccaugguguucccgagcggccagauaagccaggccagcgcacuggcaccagccccaccgcaagugcugccccaagcacccgcaccagcacccgcccccgcgauggucagcgcccuggcacaagccccagccccagucccggugcucgcaccaggaccaccccaagcagucgcaccgccagccccaaagccgacccaagccggagaaggcacccucagcgaggcgcuccugcaacuccaauucgacgacgaggaccugggagcccugcugggcaacagcaccgacccggcaguguucaccgaccuggccagcguggacaacagcgaauuccagcagcuccugaaccaaggaaucccagucgcgccacacaccaccgagccgaugcugauggaauacccagaagcgaucacgagacuggucaccggggcccaaagaccgccggacccagcgccagcaccacugggagccccaggacugcccaacggacugcucagcggcgacgaggacuucagcagcaucgcggacauggacuucagcgcacuccucggaagcggaagcggcagcagagacagccgggaaggaauguuccuccccaagccagaagccggaagcgcaaucagcgacguguucgaaggacgggaagucugccagccgaagcgccucagaccguuccacccaccgggaagcccaugggccaacagaccgcugccagccagccuggcaccgaccccaaccggaccaguccacgaaccagucggcagccugacaccagcaccagugccccagccacuggacccagcaccggcagugaccccagaagccagccaccuccuggaggaccccgacgaagaaaccagccaggccgugaaggcccugagggagauggccgacacggugaucccacagaaggaagaagcagcgaucugcggccaaauggaccucagccacccaccgccaagaggccaccuggacgagcucaccaccacccuggaaagcaugaccgaggaccucaaccucgacagcccccugacaccggagcucaacgagauccuggacaccuuccucaacgacgaaugccugcuccacgccaugcacaucagcaccggacugagcaucuucgacaccagccuguucagcgggggaaaacgaccggcagccaccaaaaaggccggacaggcgaagaagaagaaggggagcuacccguacgacgugcccgacuacgccugagcggccgcuuaauuaagcugccuucugcggggcuugccuucuggccaugcccuucuucucucccuugcaccuguaccucuuggucuuugaauaaagccugaguaggaagucuagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 164 - RNA, 2645 nt, Artificial Sequence
  source: /note="Description of Artificial Sequence: Synthetic polynucleotide"
aggaaauaagagagaaaagaagaguaagaagaaauauaagagccaccauggccccgaagaagaagcgcaaggucggcauacacggagucccagccgcuggauccuccggaucccuggaaccuggggagaaacccuauaagugcccggagugcggaaagucauucucaacuagcggaaaccugacagagcaccagaggacccauacuggcgaaaagccauacaaaugccccgaaugcgggaaaagcuucagcgacagcgggaaccugagagugcaccagcggacucauaccggggagaagccuuacaagugccccgaguguggaaaguccuucucccauaagaacgcgcuccagaaccaccagagaacccacaccggagaaaagccguacaagugcccggaaugcggcaaauccuuuucacggaacgacacucucaccgagcaccaacggacgcacaccggagagaagccguacaagugcccugaaugcggaaagagcuuuagccagagggcccaccuggaacggcaucagcgcacucacaccggggaaaagcccuacaagugcccagagugcggcaagagcuucucccggucugacaagcuugugcgccaucagcggacccacacuggagaaaaaccguacaaguguccggaguguggcaaaucguucucagacccgggacaccugguccgacaccaacgcacacacaccggcgaaaagccgaccggcaaaaagaccucggccucgggaucuggaggaggaagcggcggagaugcccuggacgacuucgaccuggacauguugggcagcgacgcacuggaugacuucgaccuggauaugcugggauccgacgcccucgacgauuucgaccucgauaugcuuggcuccgaugcgcucgaugauuucgauuuggacaugcuguccggcggaccuaagaagaagagaaaggucggcagccaauaccucccggacacugaugaccggcaccggaucgaagagaagcggaagcgcacuuacgagacuuucaagucgaucaugaagaagucacccuucucgggaccuacugauccucggccgccaccuagacggaucgcggugccauccaggucauccgcuuccguccccaagccugcgccucaaccguacccuuucacuuccucccugucgaccaucaacuacgacgaguuccccaccaugguguuccccuccggacagauuucccaagccucggcgcuagcaccagccccuccacaagugcuuccgcaagcuccagcuccggcaccagcaccagccaugguguccgcucuggcccaagcuccugcuccggugccugugcuggcuccuggaccgccucaggcaguggcaccacccgcaccaaagccgacccaagcgggagagggaacucuguccgaagcgcugcugcagcuccaguucgacgacgaggaccugggugcccugcucggaaauucgaccgauccggccguguuuaccgacuuggccaguguggacaacuccgaguuccaacagcugcugaaccaggggauuccaguggccccccacacuacugaaccgaugcugauggaauaccccgaggccauuaccagacuggucacuggagcccagaggccuccagacccugccccugcuccacugggugccccaggacugcccaaugggcuucugucgggcgaugaggauuucagcucaaucgcggauauggacuucuccgcccuucuggguuccggauccgguucacgggauuccagagagggcauguuccuacccaagcccgaagccggaagcgcgaucagcgacguguucgagggucgcgaagucugucagccaaagagacuccggccguuucauccacccggaucacccugggccaaucgcccacucccugccucauuggccccgaccccuacugguccggugcacgagccugucgggucgcucacuccggcaccugugccacaaccgcuggacccugcaccagccgugaccccagaggcgucccaccuccucgaagaucccgaugaagaaacaagccaggccgugaaggcccugcgcgaaauggccgacaccgugaucccgcagaaagaggaagccgccaucugcggucagauggaccugagccaucccccuccgagaggacaccuggacgaacugaccacuacacuggagagcaugaccgaggaccugaaccuggacuccccccuuaccccggaacugaacgagauucucgacacuuuccugaacgacgagugucugcuccacgcgaugcacaucucgaccggacugucgaucuuugacaccucgcuguucuccgguggcaaaaggccugccgccaccaagaaggccggacaggccaagaaaaagaagggcuccuacccguacgaugugcccgacuacgcuugagcggccgcuuaauuaagcugccuucugcggggcuugccuucuggccaugcccuucuucucucccuugcaccuguaccucuuggucuuugaauaaagccugaguaggaagucuagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 165 - RNA, 2645 nt, Artificial Sequence
  source: /note="Description of Artificial Sequence: Synthetic polynucleotide"
aggaaauaagagagaaaagaagaguaagaagaaauauaagagccaccauggcccccaagaaaaagcgcaaagugggcauccacggcgugccagcagcaggaagcagcggaagccuggaacccggggagaagccguacaagugcccagaaugcggaaagagcuucagcaccagcggcaaccucaccgagcaccagagaacccacaccggggagaaaccguacaaaugcccggaaugcggcaagagcuucagcgacagcggaaaccugagagugcaccaacgcacccacacgggagaaaaacccuacaaaugccccgagugcgggaaaagcuucagccacaagaacgcgcugcagaaccaccaaagaacgcacaccggagaaaagccguacaagugcccagaaugcggaaagagcuucagcagaaacgacacccugaccgaacaccagcggacgcacacaggcgaaaaaccauacaagugcccggagugcggcaaaagcuucagccagagagcgcaccuggaaaggcaccagcgcacacacaccggcgaaaagccauacaaaugcccagagugcggaaaaagcuucagccggagcgacaagcugguccgccaccaacggacccacacaggggaaaagcccuacaagugccccgaaugcggcaagagcuucagcgacccgggacaccucgugcggcaccagaggacccacaccggagaaaagccgaccgggaaaaagaccagcgcaagcgggagcggaggaggaagcggaggcgacgcacucgacgacuucgaccuggacaugcuggggagcgacgcacuggacgacuucgaccucgacaugcucggaagcgacgcccucgacgacuucgaccuggacaugcugggcagcgacgcgcuggacgacuucgaccucgacaugcucagcgggggaccaaaaaagaaaaggaaggucggaagccaguaccucccggacaccgacgacaggcaccggaucgaggaaaagcggaagcgcaccuacgaaaccuucaagagcaucaugaaaaagagccccuucagcggaccgacagacccgaggccaccaccacggagaaucgccgugccaagcaggagcagcgccagcgugcccaaaccggccccacaacccuacccguucaccagcagccucagcaccaucaacuacgacgaguucccaaccaugguguuccccagcggacagaucagccaagccagcgcacuggcaccagcccccccgcaagugcugccacaagcgccggcaccagcgccagcaccagccauggucagcgcgcuggcacaagcccccgcaccagugccagugcucgcaccaggaccaccccaggcaguagcaccgccagccccgaagccaacccaggcaggagaaggcacccucagcgaggcgcugcugcagcuccaguucgacgacgaggaccucggagcccugcugggaaacagcaccgacccagccguguucaccgaccuggccagcguggacaacagcgaauuccagcagcugcucaaccaaggaaucccgguggccccacacaccaccgaacccaugcugauggaguacccggaggccaucaccagacucgugacaggagcccagaggccaccagacccagccccagcaccacugggagccccaggacuccccaacggacugcugagcggcgacgaggacuucagcagcaucgccgacauggacuucagcgcacuccucgggagcggaagcggaagcagagacagcagggaaggaauguuccugcccaagccggaagcgggaagcgcaaucagcgacguguucgaaggaagagaagucugccagcccaagaggcugcgcccguuccacccaccaggaagcccgugggccaacagaccacugccagcaagccucgccccgacaccaaccggaccggugcacgaacccgugggcagccugaccccagcaccggucccacagccacuggacccagcacccgcagugaccccagaagccagccaccuccuggaggacccggacgaagaaaccagccaggccgucaaggcccugcgcgagauggccgacaccgucaucccccaaaaggaagaggcggccaucugcggacagauggaccugagccacccaccgccaagaggccaccucgacgagcugaccaccacccuggaaagcaugacggaggaccugaaccucgacagcccgcuaacgcccgagcugaacgaaauccuggacaccuuccucaacgacgaaugccugcugcacgccaugcacaucagcaccggacugagcaucuucgacacgagccuguucagcggaggaaaacggccagccgcaaccaagaaggccggacaagccaagaagaagaaggggagcuacccguacgacgugccagacuacgcaugagcggccgcuuaauuaagcugccuucugcggggcuugccuucuggccaugcccuucuucucucccuugcaccuguaccucuuggucuuugaauaaagccugaguaggaagucuagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 166 - protein, 888 aa, Artificial Sequence
  source: /note="Description of Artificial Sequence: Synthetic polypeptide"
MAPKKKRKVGIHGVPAAGSSGSLEPGEKPYKCPECGKSFSQRAHLERHQRTHTGEKPYKCPECGKSFSQLAHLRAHQRTHTGEKPYKCPECGKSFSSKKHLAEHQRTHTGEKPYKCPECGKSFSTTGALTEHQRTHTGEKPYKCPECGKSFSTSGNLVRHQRTHTGEKPYKCPECGKSFSQSGDLRRHQRTHTGEKPYKCPECGKSFSTSHSLTEHQRTHTGEKPTGKKTSASGSGGGSGGIFKPEELRQALMPTLEALYRQDPESLPFRQPVDPQLLGIPDYFDIVKSPMDLSTIKRKLDTGQYQEPWQYVDDIWLMFNNAWLYNRKTSRVYKYCSKLSEVFEQEIDPVMQSLGYCCGRKLEFSPQTLCCYGKQLCTIPRDATYYSYQNRYHFCEKCFNEIQGESVSLGDDPSQPQTTINKEQFSKRKNDTLDPELFVECTECGRKMHQICVLHHEIIWPAGFVCDGCLKKSARTRKENKFSAKRLPSTRLGTFLENRVNDFLRRQNHPESGEVTVRVVHASDKTVEVKPGMKARFVDSGEMAESFPYRTKALFAFEEIDGVDLCFFGMHVQEYGSDCPPPNQRRVYISYLDSVHFFRPKCLRTAVYHEILIGYLEYVKKLGYTTGHIWACPPSEGDDYIFHCHPPDQKIPKPKRLQEWYKKMLDKAVSERIVHDYKDIFKQATEDRLTSAKELPYFEGDFWPNVLEESIKELEQEEEERKREENTSNESTDVTKGDSKNAKKKNNKKTSKNKSSLSRGNKKKPGMPNVSNDLSQKLYATMEKHKEVFFVIRLIAGPAANSLPPIVDPDPLIPCDLMDGRDAFLTLARDKHLEFSSLRRAQWSTMCMLVELHTQSQDSGGKRPAATKKAGQAKKKKGSYPYDVPDYA

SEQ ID NO: 167 - RNA, 2908 nt, Artificial Sequence
  source: /note="Description of Artificial Sequence: Synthetic polynucleotide"
aggaaauaagagagaaaagaagaguaagaagaaauauaagagccaccauggcccccaagaagaagcggaaggugggcauccacggcgugcccgccgccggcagcagcggaucccucgaaccgggcgaaaagccguauaagugcccggaaugcggcaagaguuuuagccagcgcgcccaucuggaacgucaccagcguacccauaccggugaaaagccauauaaaugcccagaaugugguaaaagcuuuagucagcuggcccaucugcgcgcccaccaacguacgcacacgggcgagaagccguacaaaugcccagaaugcgguaaaagcuucagcagcaaaaagcaucuggcggaacaucaacguacccacaccggcgagaaaccauacaagugcccggaaugcgguaaaagcuucagcaccaccggugcgcugacggagcaucagcgcacccacacgggcgaaaaaccguauaaguguccggaguguggcaaaaguuuuaguaccagcggcaaucuggugcgccaucaacguacgcauaccggcgagaagccauauaaauguccagaguguggcaagagcuuuagccaaagcggugaucugcgucgccaccaacgcacgcacaccggcgaaaaaccauacaaauguccggaaugcgguaagaguuucagcacgagccauagucugaccgaacaucaacguacccauacgggugagaaaccaaccggcaagaaaaccagcgcuagcggcagcggcggcggcagcggcggcaucuucaagcccgaggagcugcggcaggcccugaugcccacccuggaggcccuguaccggcaggaccccgagagccugcccuuccggcagcccguggacccccagcugcugggcauccccgacuacuucgacaucgugaaaucccccauggaccugagcaccaucaagcggaagcuggacaccggccaguaccaggagcccuggcaguacguggacgacaucuggcugauguucaacaacgccuggcuguacaaccggaaaaccagccggguguacaaguacugcagcaagcugagcgagguguucgagcaggagaucgaccccgugaugcagagccugggcuacugcugcggccggaagcuggaguucagcccccagacccugugcugcuacggcaagcagcugugcaccaucccccgggacgccaccuacuacagcuaccagaaccgguaccacuucugcgagaagugcuucaacgagauccagggcgagagcgugagccugggcgacgaccccagccagccccagaccaccaucaacaaggagcaguucagcaagcggaagaacgacacccuggaccccgagcuguucguggagugcaccgagugcggccggaagaugcaccagaucugcgugcugcaccacgagaucaucuggcccgccggcuucgugugcgacggcugccugaagaaauccgcccggacccggaaggagaacaaguucagcgccaagcggcugcccagcacccggcugggcaccuuccuggagaaccgggugaacgacuuccugcggcggcagaaccaccccgagagcggcgaggugaccgugcggguggugcacgccagcgacaagaccguggaggugaagcccggcaugaaggcccgguucguggacagcggcgagauggccgagagcuuccccuaccggaccaaggcccuguucgccuucgaggagaucgacggcguggaccugugcuucuucggcaugcacgugcaggaguacggcagcgacugccccccccccaaccagcggcggguguacaucagcuaccuggacagcgugcacuucuuccggcccaagugccugcggaccgccguguaccacgagauccugaucggcuaccuggaguacgugaagaagcugggcuacaccaccggccacaucugggccugcccccccagcgagggcgacgacuacaucuuccacugccacccccccgaccagaagauccccaagcccaagcggcugcaggagugguacaagaagaugcuggacaaggccgugagcgagcggaucgugcacgacuacaaggacaucuucaagcaggccaccgaggaccggcugaccagcgccaaggagcugcccuacuucgagggcgacuucuggcccaacgugcuggaggagagcaucaaggagcuggagcaggaggaggaggagcggaagcgggaggagaacaccagcaacgagagcaccgacgugaccaagggcgacagcaagaacgccaagaagaagaacaacaagaaaaccagcaagaacaagagcagccugagccggggcaacaagaagaagcccggcaugcccaacgugagcaacgaccugagccagaagcuguacgccaccauggagaagcacaaggagguguucuucgugauccggcugaucgccggccccgccgccaacagccugccccccaucguggaccccgacccccugauccccugcgaccugauggacggccgggacgccuuccugacccuggcccgggacaagcaccuggaguucagcagccugcggcgggcccaguggagcaccaugugcaugcugguggagcugcacacccagagccaggacagcggcggcaagcggcccgccgccaccaagaaggccggccaggccaagaagaagaagggcagcuaccccuacgacgugcccgacuacgccugagcggccgcuuaauuaagcugccuucugcggggcuugccuucuggccaugcccuucuucucucccuugcaccuguaccucuuggucuuugaauaaagccugaguaggaagucuagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 168 - protein, 888 aa, Artificial Sequence
  source: /note="Description of Artificial Sequence: Synthetic polypeptide"
MAPKKKRKVGIHGVPAAGSSGSLEPGEKPYKCPECGKSFSRSDHLTNHQRTHTGEKPYKCPECGKSFSTSGSLVRHQRTHTGEKPYKCPECGKSFSQAGHLASHQRTHTGEKPYKCPECGKSFSRSDKLTEHQRTHTGEKPYKCPECGKSFSTSGNLTEHQRTHTGEKPYKCPECGKSFSQSSNLVRHQRTHTGEKPYKCPECGKSFSTHLDLIRHQRTHTGEKPTGKKTSASGSGGGSGGIFKPEELRQALMPTLEALYRQDPESLPFRQPVDPQLLGIPDYFDIVKSPMDLSTIKRKLDTGQYQEPWQYVDDIWLMFNNAWLYNRKTSRVYKYCSKLSEVFEQEIDPVMQSLGYCCGRKLEFSPQTLCCYGKQLCTIPRDATYYSYQNRYHFCEKCFNEIQGESVSLGDDPSQPQTTINKEQFSKRKNDTLDPELFVECTECGRKMHQICVLHHEIIWPAGFVCDGCLKKSARTRKENKFSAKRLPSTRLGTFLENRVNDFLRRQNHPESGEVTVRVVHASDKTVEVKPGMKARFVDSGEMAESFPYRTKALFAFEEIDGVDLCFFGMHVQEYGSDCPPPNQRRVYISYLDSVHFFRPKCLRTAVYHEILIGYLEYVKKLGYTTGHIWACPPSEGDDYIFHCHPPDQKIPKPKRLQEWYKKMLDKAVSERIVHDYKDIFKQATEDRLTSAKELPYFEGDFWPNVLEESIKELEQEEEERKREENTSNESTDVTKGDSKNAKKKNNKKTSKNKSSLSRGNKKKPGMPNVSNDLSQKLYATMEKHKEVFFVIRLIAGPAANSLPPIVDPDPLIPCDLMDGRDAFLTLARDKHLEFSSLRRAQWSTMCMLVELHTQSQDSGGKRPAATKKAGQAKKKKGSYPYDVPDYA

SEQ ID NO: 169 - RNA, 2908 nt, Artificial Sequence
  source: /note="Description of Artificial Sequence: Synthetic polynucleotide"
aggaaauaagagagaaaagaagaguaagaagaaauauaagagccaccauggcccccaagaagaagcggaaggugggcauccacggcgugcccgccgccggcagcagcggaucccuggaaccgggcgagaagccauacaagugcccagagugcggcaaaagcuucagccgcagcgaccaucugaccaaucaccaacgcacccauaccggugagaagccguacaaaugcccagagugcgguaagagcuuuaguaccaguggcagucugguucgucaucagcgcacgcacacgggcgaaaaaccauacaaaugcccggagugcggcaaaagcuuuagccaagccggucaucuggcgagccaucaacguacgcacaccggcgagaagccguauaaauguccggagugcgguaagagcuuuagccguagcgauaaacugaccgaacaccaacguacgcauacgggcgagaaaccauauaaauguccagaguguggcaagaguuucagcaccagcggcaaucugaccgagcaucaacguacccauaccggugaaaagccauauaaauguccagaaugcgguaagaguuuuagucagagcaguaaucuggugcgccaucagcguacccacacgggugagaaaccauauaaguguccggaaugcggcaagaguuuuagcacccaucuggaucugauccgucaucagcgcacccacaccggugaaaaaccaaccggcaagaaaaccagugcuagcggcagcggcggcggcagcggcggcaucuucaagcccgaggagcugcggcaggcccugaugcccacccuggaggcccuguaccggcaggaccccgagagccugcccuuccggcagcccguggacccccagcugcugggcauccccgacuacuucgacaucgugaaaucccccauggaccugagcaccaucaagcggaagcuggacaccggccaguaccaggagcccuggcaguacguggacgacaucuggcugauguucaacaacgccuggcuguacaaccggaaaaccagccggguguacaaguacugcagcaagcugagcgagguguucgagcaggagaucgaccccgugaugcagagccugggcuacugcugcggccggaagcuggaguucagcccccagacccugugcugcuacggcaagcagcugugcaccaucccccgggacgccaccuacuacagcuaccagaaccgguaccacuucugcgagaagugcuucaacgagauccagggcgagagcgugagccugggcgacgaccccagccagccccagaccaccaucaacaaggagcaguucagcaagcggaagaacgacacccuggaccccgagcuguucguggagugcaccgagugcggccggaagaugcaccagaucugcgugcugcaccacgagaucaucuggcccgccggcuucgugugcgacggcugccugaagaaauccgcccggacccggaaggagaacaaguucagcgccaagcggcugcccagcacccggcugggcaccuuccuggagaaccgggugaacgacuuccugcggcggcagaaccaccccgagagcggcgaggugaccgugcggguggugcacgccagcgacaagaccguggaggugaagcccggcaugaaggcccgguucguggacagcggcgagauggccgagagcuuccccuaccggaccaaggcccuguucgccuucgaggagaucgacggcguggaccugugcuucuucggcaugcacgugcaggaguacggcagcgacugccccccccccaaccagcggcggguguacaucagcuaccuggacagcgugcacuucuuccggcccaagugccugcggaccgccguguaccacgagauccugaucggcuaccuggaguacgugaagaagcugggcuacaccaccggccacaucugggccugcccccccagcgagggcgacgacuacaucuuccacugccacccccccgaccagaagauccccaagcccaagcggcugcaggagugguacaagaagaugcuggacaaggccgugagcgagcggaucgugcacgacuacaaggacaucuucaagcaggccaccgaggaccggcugaccagcgccaaggagcugcccuacuucgagggcgacuucuggcccaacgugcuggaggagagcaucaaggagcuggagcaggaggaggaggagcggaagcgggaggagaacaccagcaacgagagcaccgacgugaccaagggcgacagcaagaacgccaagaagaagaacaacaagaaaaccagcaagaacaagagcagccugagccggggcaacaagaagaagcccggcaugcccaacgugagcaacgaccugagccagaagcuguacgccaccauggagaagcacaaggagguguucuucgugauccggcugaucgccggccccgccgccaacagccugccccccaucguggaccccgacccccugauccccugcgaccugauggacggccgggacgccuuccugacccuggcccgggacaagcaccuggaguucagcagccugcggcgggcccaguggagcaccaugugcaugcugguggagcugcacacccagagccaggacagcggcggcaagcggcccgccgccaccaagaaggccggccaggccaagaagaagaagggcagcuaccccuacgacgugcccgacuacgccugagcggccgcuuaauuaagcugccuucugcggggcuugccuucuggccaugcccuucuucucucccuugcaccuguaccucuuggucuuugaauaaagccugaguaggaagucuagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 170 - protein, 1828 aa, Artificial Sequence
  source: /note="Description of Artificial Sequence: Synthetic polypeptide"
MAPKKKRKVGIHGVPAAGSSGSLEPGEKPYKCPECGKSFSRSDHLTNHQRTHTGEKPYKCPECGKSFSTSGSLVRHQRTHTGEKPYKCPECGKSFSQAGHLASHQRTHTGEKPYKCPECGKSFSRSDKLTEHQRTHTGEKPYKCPECGKSFSTSGNLTEHQRTHTGEKPYKCPECGKSFSQSSNLVRHQRTHTGEKPYKCPECGKSFSTHLDLIRHQRTHTGEKPTGKKTSASGSGGGSGGDALDDFDLDMLGSDALDDFDLDMLGSDALDDFDLDMLGSDALDDFDLDMLGSGSGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRIRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFGSGSGSDALDDFDLDMLGSDALDDFDLDMLGSDALDDFDLDMLGSDALDDFDLDMLGSGSGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRIRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFGSGSGSDALDDFDLDMLGSDALDDFDLDMLGSDALDDFDLDMLGSDALDDFDLDMLGSGSGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRIRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFGSGSGSGGGGSGKRPAATKKAGQAKKKKGSYPYDVPDYA

SEQ ID NO: 171 - RNA, 5762 nt, Artificial Sequence
  source: /note="Description of Artificial Sequence: Synthetic polynucleotide"
aggaaauaagagagaaaagaagaguaagaagaaauauaagagccaccauggcccccaagaagaagcgcaaggucgggauccacggagucccggcagcaggauccucaggcucacuggaaccgggggaaaaacccuacaagugcccggaaugcggcaagagcuucucgcgguccgaccaccugaccaaccaccagagaacacacaccggcgagaagccguacaagugccccgagugcgggaagucguucagcaccucaggaucgcugguccgccaccaacggacccacacaggagaaaagcccuacaagugcccggaaugcggaaagagcuucagccaagccgggcaccuggcaucacaccagcgaacccacaccggagaaaaaccguacaaaugcccggagugcggcaaauccuucucgcgcuccgacaagcugaccgaacaccaaaggacacacaccggagagaagcccuacaagugcccggaaugcggaaaaucguucucgaccucggggaaccugaccgagcaccaacgcacccacaccggcgaaaaaccguacaaaugcccggagugcggaaagucguucucacaauccuccaaccugguccggcaccaaagaacgcacacaggggaaaagccguacaagugccccgaaugcgggaaauccuucagcacccaccuggaccucauccggcaccagaggacccacaccggggagaagccgaccggcaaaaagaccucagcgagcggauccggaggaggaucagggggggacgcccucgacgacuucgaucuggacaugcuggguagcgacgcccuggaugacuucgaccucgauaugcugggauccgacgcacuugacgauuuugacuuggacaugcucggcuccgacgcucuggacgauuucgaccuugacaugcuuggcuccggcucaggaucccaguaccuccccgauaccgacgacagacaccggaucgaagaaaagcgcaagcgcaccuacgaaaccuucaagucgauuaugaagaagucgccuuucuccgggccgacugauccuagaccuccaccaagaagaaucgcggugccguccagaucguccgcgucagugccgaaaccagcaccgcagccguauccguucacuuccucccuuuccaccauuaacuacgacgaauuccccacgaugguguucccuagcggacagauuucgcaagccagcgcucuugcuccugcgccuccucaagugcugccucaggccccugcuccugcuccugcacccgccaugguguccgcccuggcucaagcuccagccccugugccuguccuggccccuggaccaccucaggcaguagcaccucccgcucccaagcccacccaagcgggagagggcacucuuuccgaggcccugcugcaacugcaguucgacgacgaggaccugggggcacuucugggaaauagcaccgauccggccguguucaccgaccuggccagcgucgacaacucagaguuccagcagcuccucaaccaagggauuccgguggccccucacacgaccgagccgauguugauggaauacccggaagccaucacccgccuagugaccggagcgcaaagaccgccugacccagcuccugccccuuugggagccccuggauugcccaacggacuccuguccggcgacgaggauuucucguccaucgccgauauggacuucucggcccuguuggguagcgguucggguagucgcgauagccgggaaggaauguuccugccgaagccugaggccgggucugccauuagcgauguguuugaaggacgggaagucugucagcccaagcggauucgcccauuccaccccccuggaucgccuugggccaacaggccacuccccgcuucgcuugcgccgacuccuaccgggccagugcacgaaccugugggaucccugacuccggcuccugugccacagccucuggauccggcucccgcugucaccccugaggccucacaccuucucgaggaccccgacgaagagacuucccaggccgugaaagcgcuccgggagauggcggacacugugaucccgcaaaaggaagaagccgcgauuugcggccagauggaccugucgcauccuccaccacgcggucaccucgaugaacugacaacuacccuggagucgaugaccgaggaccugaaccuggacuccccgcugacuccugagcucaacgaaauccuggacacuuuccugaacgaugagugccugcugcacgccaugcacaucuccacugggcugucaaucuucgacaccagccuguucggcuccggauccgguuccgacgcacuggacgauuuugaccuggauauguuggggagcgacgcacuggacgauuuugaucuggauaugcugggauccgacgcgcucgacgauuucgaccuggacaugcucggaucggacgcccuggacgacuucgaccucgauaugcuuggaucaggguccggcucacaauaucugccggacacugaugaccggcauagaaucgaagaaaagcgcaagcggaccuacgaaacuuucaagagcaucaugaagaaaucgccguucucugggccgacugauccuaggccgccuccgagaaggaucgccgugcccucaagauccuccgccucugugcccaagccggcuccacagccuuaccccuucacuucgucgcugagcaccaucaacuacgacgaauucccgaccauggucuuuccgagcggccagauuucccaggcguccgccuuggcuccugcaccaccccaagugcugccucaggcgccugcaccagcuccagccccugccaugguguccgcgcuggcacaagccccugcaccugugccagugcucgcaccugguccuccgcaagcuguggcaccuccugcgccuaagccgacucaggccggagaagggacccugucagaggcccugcugcaacugcaguuugacgaugaggaucugggagcccuucugggcaacucgacugaccccgccguguucaccgaccuggcguccguggauaacuccgaguuccagcagcuccucaaccaagggauuccugucgccccgcacacuaccgagccgaugcugauggaguacccggaggccaucacccggcuugugacgggugcucagaggccuccagauccggcuccagcaccguuaggagcccccggacuuccuaacggacugcuguccggcgacgaggacuucuccagcaucgccgacauggauuuuuccgcgcuguugggaucggguuccggcucaagagacagccgcgagggaauguuccucccgaaaccagaggccggcucagccaucagcgacguguucgaagggcgcgaagucugccagcccaagcggauccgcccguuucauccgccuggaucaccgugggccaacagaccccuacccgcaagcuuagccccuacccccacuggcccuguccacgaaccugugggcucccugacacccgcuccugugccacaaccucuggaccccgcaccagcagucacacccgaagccagccaccuccuugaggauccggacgaggagacuagccaggccgugaaggcgcuccgcgaaauggccgacacugugaucccucaaaaggaagaggcggccauuuguggacagauggacuugucccacccgccuccaagaggucaccuggacgaacuuaccaccacgcucgaauccaugacugaggaucugaaccuggauuccccgcucacucccgagcucaacgaaauccuugauaccuuccuuaacgacgagugucuccugcaugccaugcacaucuccaccggacugagcauuuucgacaccucgcuguucgguuccggaagcggcucagacgcgcuggaugacuucgauuuggacaugcuuggcagcgaugcccuggaugauuucgaccuggacaugcucgggucggaugcgcuggacgacuucgaucucgauauguugggcuccgaugcccucgacgacuuugaccucgacaugcugggcucgggcucaggaucccaauaccucccggauaccgacgacaggcaucgcauugaggaaaagcggaagcgcaccuaugaaaccuucaaguccauuaugaagaagucgcccuuuuccggaccgacugacccucggccuccuccucgacgaauugccgucccaucucggucauccgccucgguccccaagccagcaccgcagccuuauccguucaccuccucucuguccaccauuaacuacgaugaauuccccaccaugguguucccgucgggacagaucucccaagccucagcccuugcuccugccccuccacaaguccugccccaagcaccagcgccugcuccugcacccgcgaugguguccgcacuggcgcaagcuccugccccugugccugugcuggcuccuggaccaccccaggcaguagcaccuccagccccgaagcccacucaggcuggagagggaacccugagcgaagcgcugcugcagcuccaguucgacgacgaagaucugggugcccugcugggaaauuccaccgauccggcgguguucacagaccuggccuccguggacaacuccgaauuccagcaguuguugaaccagggcauuccuguggccccccacaccacugagccaaugcucauggaauaccccgaggccauuaccagacucgugaccggagcccaaaggccuccggauccagcgccagcuccguugggagcuccgggauugccgaacgggcugcugucgggagaugaagauuucuccucaaucgccgauauggacuucuccgcgcugcuggguucggguucgggaucgcgcgauagccgggagggcauguuccuaccgaagccugaggccggaagcgccaucuccgauguguucgagggcagagaagucugucagccuaagcgcauucgcccguuccacccuccuggaucgcccugggccaaucggccacugccugcgucccucgcuccaacgccgaccggaccugugcacgaaccggucggcucacugacuccagcucccgucccacaaccgcucgacccugcucccgcuguuacccccgaagccucccauuugcuggaagaucccgaugaggaaacuucccaggccgucaaggcccugcgggagauggcagacaccgugauaccccagaaggaagaagcugccaucugcgggcagauggaccugucccauccuccuccacgcggacacuuggacgagcugaccacuacucuggaguccaugaccgaggaccugaaccuugacucgccuuugaccccugaacugaacgaaauucuggacaccuuccugaaugacgagugccuccugcacgcgaugcacaucagcaccggacuguccaucuucgacacuucccucuuugggagcggguccggaucaggcgguggugguagcgggaaacggccagcagcgaccaagaaggccggacaggccaagaagaagaaaggcucauaccccuacgacgugccggacuacgcaugagcggccgcuuaauuaagcugccuucugcggggcuugccuucuggccaugcccuucuucucucccuugcaccuguaccucuuggucuuugaauaaagccugaguaggaagucuagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 172 - protein, 2996 aa, Artificial Sequence
  source: /note="Description of Artificial Sequence: Synthetic polypeptide"
MAPKKKRKVGIHGVPAADKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVAAIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGKRPAATKKAGQAKKKKSGGGGSDALDDFDLDMLGSDALDDFDLDMLGSDALDDFDLDMLGSDALDDFDLDMLGSGSGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRIRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFGSGSGSDALDDFDLDMLGSDALDDFDLDMLGSDALDDFDLDMLGSDALDDFDLDMLGSGSGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRIRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFGSGSGSDALDDFDLDMLGSDALDDFDLDMLGSDALDDFDLDMLGSDALDDFDLDMLGSGSGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRIRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFGSGSGSGGGGSGKRPAATKKAGQAKKKKGSYPYDVPDYA

SEQ ID NO: 173 - RNA, 9266 nt, Artificial Sequence
  source: /note="Description of Artificial Sequence: Synthetic polynucleotide"
aggaaauaagagagaaaagaagaguaagaagaaauauaagagccaccauggcccccaagaagaagaggaaagucggaauucacggagugccugcagcggauaagaaguacuccaucggacucgcaaucggcaccaacuccgugggaugggccgugaucaccgacgaguacaaagugccgucuaaaaaguucaaggugcucggaaacaccgauaggcacuccaucaagaagaaccugauuggggcccugcuguuugauuccggggaaacggcagaggccacucgccucaagagaacugcacgccggcgguacacucgucggaagaaccgcaucugcuaucugcaagagauuuucuccaacgagauggccaaaguggacgacucauucuuccaccgccucgaagaaucuuuccuggucgaagaggacaagaagcacgaacgccaccccauuuucgggaacauugucgacgaaguggcguaccacgagaaguaccccaccaucuaccaucuccgcaagaagcucguggauuccacugacaaggccgaucucagacugaucuaccuggcgcuugcucacaugauuaaguucaggggucacuuccugauugagggagaucugaaccccgacaacagcgaugucgauaagcuguucauucagcuggugcagaccuacaaucagcuguucgaagagaaccccauuaaugccuccggugucgaugccaaggccauccuguccgcacggcugagcaaaucgcgcaggcuggaaaaccugaucgcccagcugccuggagagaaaaagaacggacuguucggcaaccuuaucgcgcuguccuugggacugaccccgaacuucaagagcaacuucgacuuggccgaggaugccaagcugcaacugucgaaggacaccuacgacgaugaccucgauaaucugcuggcccaaauuggcgaucaauaugcagaccuguuccuugccgcaaagaaccugagcgacgcgauucuccugucggacauccugcgggucaacaccgagaucaccaaggcaccguuguccgccuccaugauuaagcgauacgacgaacaccaucaggaccugacucugcugaaggcccugguccgccaacagcugcccgagaaguacaaggagaucuucuucgaccaauccaagaauggauacgcuggauacaucgauggcggugccagccaagaggaauucuacaaguucaucaaaccgauacuggagaagauggacggcacagaggaacuccuggucaagcugaaccgggaggaucugcugcggaagcagaggaccuucgacaacggguccaucccgcaccagauucaccugggcgaacugcaugcgauccugcgacggcaggaggacuucuacccauuccugaaggauaacagagagaaaaucgagaagauccucaccuuccggaucccguauuacgugggaccccuggcuaggggcaacagccgcuucgccuggaugacccgcaaguccgaggaaacuauuacucccuggaacuucgaggaaguaguggacaaaggcgccagcgcgcaauccuucaucgaacggaugaccaacuucgacaagaacuugccgaacgaaaagguguugccgaagcauucucugcuguaugaguacuucacuguguacaacgaacugaccaaagugaaauacgucacagaaggaaugagaaagccagccuuccuuagcggggagcagaagaaggccauuguggaccuccuguucaaaaccaaccgaaaggucaccgugaagcaacugaaggaggauuacuucaagaagaucgaauguuucgacucgguggagaucuccgggguggaggaucgcuucaaugccucccugggcaccuaccaugaucugcucaagaucaucaaggauaaggacuuccucgacaacgaagagaacgaagauauccuggaggauaucgugcucacccucacccuguucgaggauagagagaugaucgaagagagacuuaagaccuacgcccaccuguucgacgacaaagucaugaagcagcugaagcggaggagguacacuggauggggcagacugucccgcaagcucaucaacgggauucgagauaagcaguccggaaagacaauccucgacuuccugaaauccgacggauuugccaacagaaacuucaugcagcugauccaugaugacucgcugaccuucaaggaggauauucagaaggcucaagugucgggacagggcgauucccuccacgagcacaucgccaaccucgcgggauccccugcaaucaagaaggguauccugcagaccgugaaggucguggacgaauuagugaaagucaugggccggcauaagccugaaaacaucgugaucgagauggcccgggaaaaccagaccacccaaaagggacagaagaacucccgcgagcgcaugaagcggaucgaggaagggaucaaggagcuggggucgcagaucuuaaaggagcaccccguggaaaauacucagcugcaaaacgaaaagcuguaccuguauuacuugcaaaacggaagagauauguacguggaucaagaauuggacaucaacagacucuccgacuacgacgucgcugcgauugugccacaaagcuuucuuaaggacgacuccaucgacaacaagguccucacccgguccgauaaggcccgcggaaaguccgacaacgugccaagcgaagagguggucaagaagaugaagaauuacuggcggcagcugcugaacgccaagcugauaacucagcggaaguucgacaaccugacuaaggcugagcggggaggacucucggaacuggacaaggcuggguucaucaagagacaguugguggaaacccgccaaauuaccaaacacguggcgcagauccuggacucacgcaugaacacuaaguacgacgagaacgauaagcugauucgggaagucaaagugaucacccugaaguccaagcucgucagcgacuuccggaaggauuuccaguuuuacaagguccgcgaaauuaacaacuaccaucaugcucacgacgccuacuugaacgccguggucgguaccgcccugaucaagaaguauccaaagcucgaguccgaguuuguguacggcgacuacaaggucuacgacgugcgcaagaugaucgcgaaauccgagcaggaaaucggaaaggccaccgccaaguacuucuucuacucaaacauuaugaacuucuucaagaccgaaaucacucuggcgaacggcgaaauccggaaaagaccgcugaucgagacuaacggcgaaaccggcgaaaucgugugggacaagggacgggacuucgccaccgugcgcaaggugcugucgaugccccaagugaacauugugaagaaaaccgaaguccagacuggcggcuucagcaaagaaucgauccugcccaagagaaacagcgacaagcugaucgcccgcaagaaggacugggaccccaagaaauacggcgguuucgacucacccacuguggccuacucgguccucguggucgccaaggucgagaagggcaaaagcaaaaagcuuaaaucggugaaggaacuucuggguaucacgaucauggaacgcuccuccuucgaaaagaaccccaucgacuuuuuggaagcaaagggauacaaggaagucaagaaggaccucaucaucaagcugccgaaguauagccucuucgaacuggagaacggucggaagagaaugcuggcuucagcgggagagcugcaaaagggaaacgagcuggcccuuccgagcaaauacgucaacuuucuguaccuggccucgcacuacgaaaagcucaagggaucacccgaggacaacgaacagaagcaacuguucguggaacagcauaagcauuaccuggaugagauuaucgaacagauuuccgaauucuccaagcgcgugauucuggccgacgccaaccuggacaagguccuuucagccuacaacaagcaccgggauaagccgauccgggaacaggcggaaaacaucauccaucuguucacguugacuaaucuuggagcaccagccgcguuuaaguacuuugacaccaccauugacaggaaacgguacacauccacgaaggaaguguuggaugcgacgcugauucaucagaguaucaccggacucuacgaaacgcggauugaccucagccaguugggaggggacuccggaggaaagaggccagccgccacuaagaaggcugggcaggccaagaagaaaaaguccgguggaggaggcucagacgcccucgacgacuucgaucuggacaugcuggguagcgacgcccuggaugacuucgaccucgauaugcugggauccgacgcacuugacgauuuugacuuggacaugcucggcuccgacgcucuggacgauuucgaccuugacaugcuuggcuccggcucaggaucccaguaccuccccgauaccgacgacagacaccggaucgaagaaaagcgcaagcgcaccuacgaaaccuucaagucgauuaugaagaagucgccuuucuccgggccgacugauccuagaccuccaccaagaagaaucgcggugccguccagaucguccgcgucagugccgaaaccagcaccgcagccguauccguucacuuccucccuuuccaccauuaacuacgacgaauuccccacgaugguguucccuagcggacagauuucgcaagccagcgcucuugcuccugcgccuccucaagugcugccucaggccccugcuccugcuccugcacccgccaugguguccgcccuggcucaagcuccagccccugugccuguccuggccccuggaccaccucaggcaguagcaccucccgcucccaagcccacccaagcgggagagggcacucuuuccgaggcccugcugcaacugcaguucgacgacgaggaccugggggcacuucugggaaauagcaccgauccggccguguucaccgaccuggccagcgucgacaacucagaguuccagcagcuccucaaccaagggauuccgguggccccucacacgaccgagccgauguugauggaauacccggaagccaucacccgccuagugaccggagcgcaaagaccgccugacccagcuccugccccuuugggagccccuggauugcccaacggacuccuguccggcgacgaggauuucucguccaucgccgauauggacuucucggcccuguuggguagcgguucggguagucgcgauagccgggaaggaauguuccugccgaagccugaggccgggucugccauuagcgauguguuugaaggacgggaagucugucagcccaagcggauucgcccauuccaccccccuggaucgccuugggccaacaggccacuccccgcuucgcuugcgccgacuccuaccgggccagugcacgaaccugugggaucccugacuccggcuccugugccacagccucuggauccggcucccgcugucaccccugaggccucacaccuucucgaggaccccgacgaagagacuucccaggccgugaaagcgcuccgggagauggcggacacugugaucccgcaaaaggaagaagccgcgauuugcggccagauggaccugucgcauccuccaccacgcggucaccucgaugaacugacaacuacccuggagucgaugaccgaggaccugaaccuggacuccccgcugacuccugagcucaacgaaauccuggacacuuuccugaacgaugagugccugcugcacgccaugcacaucuccacugggcugucaaucuucgacaccagccuguucggcuccggauccgguuccgacgcacuggacgauuuugaccuggauauguuggggagcgacgcacuggacgauuuugaucuggauaugcugggauccgacgcgcucgacgauuucgaccuggacaugcucggaucggacgcccuggacgacuucgaccucgauaugcuuggaucaggguccggcucacaauaucugccggacacugaugaccggcauagaaucgaagaaaagcgcaagcggaccuacgaaacuuucaagagcaucaugaagaaaucgccguucucugggccgacugauccuaggccgccuccgagaaggaucgccgugcccucaagauccuccgccucugugcccaagccggcuccacagccuuaccccuucacuucgucgcugagcaccaucaacuacgacgaauucccgaccauggucuuuccgagcggccagauuucccaggcguccgccuuggcuccugcaccaccccaagugcugccucaggcgccugcaccagcuccagccccugccaugguguccgcgcuggcacaagccccugcaccugugccagugcucgcaccugguccuccgcaagcuguggcaccuccugcgccuaagccgacucaggccggagaagggacccugucagaggcccugcugcaacugcaguuugacgaugaggaucugggagcccuucugggcaacucgacugaccccgccguguucaccgaccuggcguccguggauaacuccgaguuccagcagcuccucaaccaagggauuccugucgccccgcacacuaccgagccgaugcugauggaguacccggaggccaucacccggcuugugacgggugcucagaggccuccagauccggcuccagcaccguuaggagcccccggacuuccuaacggacugcuguccggcgacgaggacuucuccagcaucgccgacauggauuuuuccgcgcuguugggaucggguuccggcucaagagacagccgcgagggaauguuccucccgaaaccagaggccggcucagccaucagcgacguguucgaagggcgcgaagucugccagcccaagcggauccgcccguuucauccgccuggaucaccgugggccaacagaccccuacccgcaagcuuagccccuacccccacuggcccuguccacgaaccugugggcucccugacacccgcuccugugccacaaccucuggaccccgcaccagcagucacacccgaagccagccaccuccuugaggauccggacgaggagacuagccaggccgugaaggcgcuccgcgaaauggccgacacugugaucccucaaaaggaagaggcggccauuuguggacagauggacuugucccacccgccuccaagaggucaccuggacgaacuuaccaccacgcucgaauccaugacugaggaucugaaccuggauuccccgcucacucccgagcucaacgaaauccuugauaccuuccuuaacgacgagugucuccugcaugccaugcacaucuccaccggacugagcauuuucgacaccucgcuguucgguuccggaagcggcucagacgcgcuggaugacuucgauuuggacaugcuuggcagcgaugcccuggaugauuucgaccuggacaugcucgggucggaugcgcuggacgacuucgaucucgauauguugggcuccgaugcccucgacgacuuugaccucgacaugcugggcucgggcucaggaucccaauaccucccggauaccgacgacaggcaucgcauugaggaaaagcggaagcgcaccuaugaaaccuucaaguccauuaugaagaagucgcccuuuuccggaccgacugacccucggccuccuccucgacgaauugccgucccaucucggucauccgccucgguccccaagccagcaccgcagccuuauccguucaccuccucucuguccaccauuaacuacgaugaauuccccaccaugguguucccgucgggacagaucucccaagccucagcccuugcuccugccccuccacaaguccugccccaagcaccagcgccugcuccugcacccgcgaugguguccgcacuggcgcaagcuccugccccugugccugugcuggcuccuggaccaccccaggcaguagcaccuccagccccgaagcccacucaggcuggagagggaacccugagcgaagcgcugcugcagcuccaguucgacgacgaagaucugggugcccugcugggaaauuccaccgauccggcgguguucacagaccuggccuccguggacaacuccgaauuccagcaguuguugaaccagggcauuccuguggccccccacaccacugagccaaugcucauggaauaccccgaggccauuaccagacucgugaccggagcccaaaggccuccggauccagcgccagcuccguugggagcuccgggauugccgaacgggcugcugucgggagaugaagauuucuccucaaucgccgauauggacuucuccgcgcugcuggguucggguucgggaucgcgcgauagccgggagggcauguuccuaccgaagccugaggccggaagcgccaucuccgauguguucgagggcagagaagucugucagccuaagcgcauucgcccguuccacccuccuggaucgcccugggccaaucggccacugccugcgucccucgcuccaacgccgaccggaccugugcacgaaccggucggcucacugacuccagcucccgucccacaaccgcucgacccugcucccgcuguuacccccgaagccucccauuugcuggaagaucccgaugaggaaacuucccaggccgucaaggcccugcgggagauggcagacaccgugauaccccagaaggaagaagcugccaucugcgggcagauggaccugucccauccuccuccacgcggacacuuggacgagcugaccacuacucuggaguccaugaccgaggaccugaaccuugacucgccuuugaccccugaacugaacgaaauucuggacaccuuccugaaugacgagugccuccugcacgcgaugcacaucagcaccggacuguccaucuucgacacuucccucuuugggagcggguccggaucaggcgguggugguagcgggaaacggccagcagcgaccaagaaggccggacaggccaagaagaagaaaggcucauaccccuacgacgugccggacuacgcaugagcggccgcuuaauuaagcugccuucugcggggcuugccuucuggccaugcccuucuucucucccuugcaccuguaccucuuggucuuugaauaaagccugaguaggaagucuagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 174 - protein, 263 aa, Artificial Sequence
  source: /note="Description of Artificial Sequence: Synthetic polypeptide"
MAPKKKRKVGIHGVPAAGSSGSLEPGEKPYKCPECGKSFSTSGNLTEHQRTHTGEKPYKCPECGKSFSDSGNLRVHQRTHTGEKPYKCPECGKSFSHKNALQNHQRTHTGEKPYKCPECGKSFSRNDTLTEHQRTHTGEKPYKCPECGKSFSQRAHLERHQRTHTGEKPYKCPECGKSFSRSDKLVRHQRTHTGEKPYKCPECGKSFSDPGHLVRHQRTHTGEKPTGKKTSASSGGKRPAATKKAGQAKKKKGSYPYDVPDYA

SEQ ID NO: 175 - RNA, 1033 nt, Artificial Sequence
  source: /note="Description of Artificial Sequence: Synthetic polynucleotide"
aggaaauaagagagaaaagaagaguaagaagaaauauaagagccaccauggcccccaagaagaagcggaaggugggcauccacggcgugcccgccgccggcagcagcggaucccucgaaccgggcgagaaaccauauaaguguccagagugugguaagagcuuuagcaccaguggcaaucugaccgagcaucaacgcacgcauacgggugagaaaccguacaagugcccggaaugcggcaaaaguuucagcgauagcggcaaucugcgugugcaccagcguacgcauacgggcgaaaagccguauaagugcccagaaugcgguaagaguuuuagccacaaaaacgcgcugcagaaccaccagcgcacccacacgggugagaagccauacaaauguccggaaugcggcaaaagcuucagccgcaacgauacgcugacggaacaccaacguacgcauaccggcgaaaagccauacaagugcccggagugcgguaaaagcuuuagccagcgcgcgcaucucgaacgucaucaacguacccauaccggugaaaaaccauauaaaugcccggaaugugguaaaaguuuuagccgcagcgacaaacuggugcgucaucaacgcacccauaccggugaaaagccauauaagugcccggagugugguaaaagcuucagcgauccgggucaucugguucgccaucaacguacgcacaccggcgagaagccaaccggcaagaaaaccagcgcuagcagcggcggcaagcggcccgccgccaccaagaaggccggccaggccaagaagaagaagggcagcuaccccuacgacgugcccgacuacgccugagcggccgcuuaauuaagcugccuucugcggggcuugccuucuggccaugcccuucuucucucccuugcaccuguaccucuuggucuuugaauaaagccugaguaggaagucuagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 176 - protein, 1614 aa, Artificial Sequence
  source: /note="Description of Artificial Sequence: Synthetic polypeptide"
MAPKKKRKVGIHGVPAAGSSGSSGSLEPGEKPYKCPECGKSFSTSGNLTEHQRTHTGEKPYKCPECGKSFSDSGNLRVHQRTHTGEKPYKCPECGKSFSHKNALQNHQRTHTGEKPYKCPECGKSFSRNDTLTEHQRTHTGEKPYKCPECGKSFSQRAHLERHQRTHTGEKPYKCPECGKSFSRSDKLVRHQRTHTGEKPYKCPECGKSFSDPGHLVRHQRTHTGEKPTGKKTSASGSGGGSGGDALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRLRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFSGGKRPAATKKAGQAKKKKGSYPYDVPDYAATNFSLLKQAGDVEENPGPTSAGKLGSGEGRGSLLTCGDVEENPGPLEGSSGSGSLEPGEKPYKCPECGKSFSRSDHLTNHQRTHTGEKPYKCPECGKSFSTSGSLVRHQRTHTGEKPYKCPECGKSFSQAGHLASHQRTHTGEKPYKCPECGKSFSRSDKLTEHQRTHTGEKPYKCPECGKSFSTSGNLTEHQRTHTGEKPYKCPECGKSFSQSSNLVRHQRTHTGEKPYKCPECGKSFSTHLDLIRHQRTHTGEKPTGKKTSASGSGGGSGGDALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRLRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFSGGKRPAATKKAGQAKKKKGSYPYDVPDYA

SEQ ID NO: 177 - RNA, 5086 nt, Artificial Sequence
  source: /note="Description of Artificial Sequence: Synthetic polynucleotide"
aggaaauaagagagaaaagaagaguaagaagaaauauaagagccaccauggcccccaagaagaagcggaaggugggcauccacggcgugcccgccgccggcagcagcggaucaucaggcucacuggaaccgggggaaaaacccuacaagugcccggaaugcggcaagagcuucucgaccuccgggaaccugaccgagcaccagcgcacccacaccggagagaaaccguacaagugccccgaaugcgggaaaucguucucagacucgggaaaccucagggugcaccagcggacccacacgggggaaaagccguacaaaugcccggagugcgggaagucauucucccacaagaacgcgcugcagaaccaccaaagaacccacaccggcgaaaaaccguacaagugccccgagugcggaaaguccuucucccgcaacgacacccucaccgaacaccaacgcacccacaccggagaaaagcccuacaagugcccggaaugcggaaagagcuucagccagagggcccaccuggaaagacaccagagaacccacaccggcgaaaagccguacaaaugcccggagugcgggaaguccuucagccggucagacaagcugguccgccaccaaaggacccacacaggagaaaagcccuacaagugcccggaaugcggaaaaucguucagcgaccccggacaccugguccggcaccagaggacccacaccggggagaagccgaccggcaaaaagaccucagcgagcggaucaggaggaggaucagggggggacgcacuggacgacuucgaccuggacaugcugggaucagacgcacuggacgacuucgaccuagacaugcucggaucggacgcacucgacgacuucgaccucgacaugcuaggaucagacgcacuagacgacuucgaccucgacaugcugucgggaggaccgaagaaaaagcggaaggucggaucacaguaccucccggacaccgacgacaggcacagaaucgaagaaaaacgcaagcgcaccuacgaaaccuucaagagcaucaugaaaaagucgccguucucaggaccgaccgaccccagaccgccaccgaggagaauagccgucccgagccgauccuccgcauccgugccgaaaccggcaccgcaacccuacccguucaccucgucccugucgaccaucaacuacgacgaguuccccaccaugguguuccccuccgggcagaucucacaggccucggcacuggcacccgcaccaccgcaagugcugccccaagcaccggcacccgcaccggcgcccgcaauggugucagcgcuggcacaggcaccagcaccggugccaguccucgcaccgggaccgccgcaagcaguggcaccgccggcaccgaaaccgacccaggccggagaagggacccuguccgaggcgcugcugcaacuccaguucgacgacgaggaccugggagcacuccugggaaacuccaccgacccggcaguguucaccgaccucgcaucgguggacaacuccgaguuccaacagcuccugaaccaggggauaccgguggcaccgcacaccaccgaaccgaugcugauggaauacccggaagccaucacccggcucgugaccggagcgcaaagaccgcccgaccccgcgcccgcaccgcugggagcaccgggacuaccgaacgggcugcucucaggggacgaggacuucuccagcaucgcagacauggacuucuccgcccugcugggaucaggaucaggaucacgcgacucccgggaaggaauguuccugccgaagccggaagcaggcagcgcaaucuccgacguguucgaaggccgcgaggucugccagcccaagcgccugcgaccguuccacccgccgggaucaccgugggcaaaccgcccgcuaccggcaucacuggcaccgacacccaccggaccggugcacgaaccggucgggucacugacccccgcaccggucccgcaaccgcuagacccggcaccggcagugaccccggaagcaucgcaccuccuggaggacccggacgaggaaaccucacaggcagugaaggcccugcgggagauggccgacaccgugauaccgcagaaggaggaggccgccaucugcggacaaauggaccugucacacccgcccccgagaggacaccuggacgaacucaccaccacccuggagagcaugaccgaggaccugaaccuggacucaccgcugaccccggagcugaacgaaauccuggacaccuuccugaacgacgagugccugcugcacgcaaugcacaucagcaccgggcugucgaucuucgacaccagccuguucuccggagggaaaagacccgccgccaccaagaaagcgggccaagcaaagaaaaagaagggaucguaccccuacgacgugccggacuacgcagccaccaacuuuucucugcugaagcaagccggagauguggaggagaaucccggcccuaccuccgccggaaaacugggcuccggcgaaggcagaggaagccuccucacaugcggcgacguggaggagaaccccggcccucuggagggauccucaggcucaggaucccuggaaccgggcgagaagccauacaagugcccagagugcggcaaaagcuucagccgcagcgaccaucugaccaaucaccaacgcacccauaccggugagaagccguacaaaugcccagagugcgguaagagcuuuaguaccaguggcagucugguucgucaucagcgcacgcacacgggcgaaaaaccauacaaaugcccggagugcggcaaaagcuuuagccaagccggucaucuggcgagccaucaacguacgcacaccggcgagaagccguauaaauguccggagugcgguaagagcuuuagccguagcgauaaacugaccgaacaccaacguacgcauacgggcgagaaaccauauaaauguccagaguguggcaagaguuucagcaccagcggcaaucugaccgagcaucaacguacccauaccggugaaaagccauauaaauguccagaaugcgguaagaguuuuagucagagcaguaaucuggugcgccaucagcguacccacacgggugagaaaccauauaaguguccggaaugcggcaagaguuuuagcacccaucuggaucugauccgucaucagcgcacccacaccggugaaaaaccaaccggcaagaaaaccagugcuagcggcagcggcggcggcagcggcggcgacgcccuggacgacuucgaccuggacaugcugggcagcgacgcccuggacgacuucgaccuggacaugcugggcagcgacgcccuggacgacuucgaccuggacaugcugggcagcgacgcccuggacgacuucgaccuggacaugcugagcggcggccccaagaagaagcggaaggugggcagccaguaccugcccgacaccgacgaccggcaccggaucgaggagaagcggaagcggaccuacgagaccuucaagagcaucaugaagaaaucccccuucagcggccccaccgacccccggccccccccccggcggaucgccgugcccagccggagcagcgccagcgugcccaagcccgccccccagcccuaccccuucaccagcagccugagcaccaucaacuacgacgaguuccccaccaugguguuccccagcggccagaucagccaggccagcgcccuggcccccgcccccccccaggugcugccccaggcccccgcccccgcccccgcccccgccauggugagcgcccuggcccaggcccccgcccccgugcccgugcuggcccccggccccccccaggccguggccccccccgcccccaagcccacccaggccggcgagggcacccugagcgaggcccugcugcagcugcaguucgacgacgaggaccugggcgcccugcugggcaacagcaccgaccccgccguguucaccgaccuggccagcguggacaacagcgaguuccagcagcugcugaaccagggcauccccguggccccccacaccaccgagcccaugcugauggaguaccccgaggccaucacccggcuggugaccggcgcccagcggccccccgaccccgcccccgccccccugggcgcccccggccugcccaacggccugcugagcggcgacgaggacuucagcagcaucgccgacauggacuucagcgcccugcugggcagcggcagcggcagccgggacagccgggagggcauguuccugcccaagcccgaggccggcagcgccaucagcgacguguucgagggccgggaggugugccagcccaagcggcuccggcccuuccacccccccggcagccccugggccaaccggccccugcccgccagccuggcccccacccccaccggccccgugcacgagcccgugggcagccugacccccgcccccgugccccagccccuggaccccgcccccgccgugacccccgaggccagccaccugcuggaggaccccgacgaggagaccagccaggccgugaaggcccugcgggagauggccgacaccgugaucccccagaaggaggaggccgccaucugcggccagauggaccugagccacccccccccccggggccaccuggacgagcugaccaccacccuggagagcaugaccgaggaccugaaccuggacagcccccugacccccgagcugaacgagauccuggacaccuuccugaacgacgagugccugcugcacgccaugcacaucagcaccggccugagcaucuucgacaccagccuguucagcggcggcaagcggcccgccgccaccaagaaggccggccaggccaagaagaagaagggcagcuaccccuacgacgugcccgacuacgccugagcggccgcuuaauuaagcugccuucugcggggcuugccuucuggccaugcccuucuucucucccuugcaccuguaccucuuggucuuugaauaaagccugaguaggaagucuagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 178 - protein, 1609 aa, Artificial Sequence
  source: /note="Description of Artificial Sequence: Synthetic polypeptide"
MAPKKKRKVGIHGVPAAGSSGSLEPGEKPYKCPECGKSFSRSDHLTNHQRTHTGEKPYKCPECGKSFSTSGSLVRHQRTHTGEKPYKCPECGKSFSQAGHLASHQRTHTGEKPYKCPECGKSFSRSDKLTEHQRTHTGEKPYKCPECGKSFSTSGNLTEHQRTHTGEKPYKCPECGKSFSQSSNLVRHQRTHTGEKPYKCPECGKSFSTHLDLIRHQRTHTGEKPTGKKTSASGSGGGSGGDALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRLRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFSGGKRPAATKKAGQAKKKKGSYPYDVPDYAATNFSLLKQAGDVEENPGPTSAGKLGSGEGRGSLLTCGDVEENPGPLEGSSGSLEPGEKPYKCPECGKSFSTSGNLTEHQRTHTGEKPYKCPECGKSFSDSGNLRVHQRTHTGEKPYKCPECGKSFSHKNALQNHQRTHTGEKPYKCPECGKSFSRNDTLTEHQRTHTGEKPYKCPECGKSFSQRAHLERHQRTHTGEKPYKCPECGKSFSRSDKLVRHQRTHTGEKPYKCPECGKSFSDPGHLVRHQRTHTGEKPTGKKTSASGSGGGSGGDALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRLRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFSGGKRPAATKKAGQAKKKKGSYPYDVPDYA

SEQ ID NO: 179 - RNA, 5071 nt, Artificial Sequence
  source: /note="Description of Artificial Sequence: Synthetic polynucleotide"
aggaaauaagagagaaaagaagaguaagaagaaauauaagagccaccauggcccccaagaagaagcggaaggugggcauccacggcgugcccgccgccggcagcagcggaucccuggaaccgggcgagaagccauacaagugcccagagugcggcaaaagcuucagccgcagcgaccaucugaccaaucaccaacgcacccauaccggugagaagccguacaaaugcccagagugcgguaagagcuuuaguaccaguggcagucugguucgucaucagcgcacgcacacgggcgaaaaaccauacaaaugcccggagugcggcaaaagcuuuagccaagccggucaucuggcgagccaucaacguacgcacaccggcgagaagccguauaaauguccggagugcgguaagagcuuuagccguagcgauaaacugaccgaacaccaacguacgcauacgggcgagaaaccauauaaauguccagaguguggcaagaguuucagcaccagcggcaaucugaccgagcaucaacguacccauaccggugaaaagccauauaaauguccagaaugcgguaagaguuuuagucagagcaguaaucuggugcgccaucagcguacccacacgggugagaaaccauauaaguguccggaaugcggcaagaguuuuagcacccaucuggaucugauccgucaucagcgcacccacaccggugaaaaaccaaccggcaagaaaaccagugcuagcggcagcggcggcggcagcggcggcgacgcccuggacgacuucgaccuggacaugcugggcagcgacgcccuggacgacuucgaccuggacaugcugggcagcgacgcccuggacgacuucgaccuggacaugcugggcagcgacgcccuggacgacuucgaccuggacaugcugagcggcggccccaagaagaagcggaaggugggcagccaguaccugcccgacaccgacgaccggcaccggaucgaggagaagcggaagcggaccuacgagaccuucaagagcaucaugaagaaaucccccuucagcggccccaccgacccccggccccccccccggcggaucgccgugcccagccggagcagcgccagcgugcccaagcccgccccccagcccuaccccuucaccagcagccugagcaccaucaacuacgacgaguuccccaccaugguguuccccagcggccagaucagccaggccagcgcccuggcccccgcccccccccaggugcugccccaggcccccgcccccgcccccgcccccgccauggugagcgcccuggcccaggcccccgcccccgugcccgugcuggcccccggccccccccaggccguggccccccccgcccccaagcccacccaggccggcgagggcacccugagcgaggcccugcugcagcugcaguucgacgacgaggaccugggcgcccugcugggcaacagcaccgaccccgccguguucaccgaccuggccagcguggacaacagcgaguuccagcagcugcugaaccagggcauccccguggccccccacaccaccgagcccaugcugauggaguaccccgaggccaucacccggcuggugaccggcgcccagcggccccccgaccccgcccccgccccccugggcgcccccggccugcccaacggccugcugagcggcgacgaggacuucagcagcaucgccgacauggacuucagcgcccugcugggcagcggcagcggcagccgggacagccgggagggcauguuccugcccaagcccgaggccggcagcgccaucagcgacguguucgagggccgggaggugugccagcccaagcggcuccggcccuuccacccccccggcagccccugggccaaccggccccugcccgccagccuggcccccacccccaccggccccgugcacgagcccgugggcagccugacccccgcccccgugccccagccccuggaccccgcccccgccgugacccccgaggccagccaccugcuggaggaccccgacgaggagaccagccaggccgugaaggcccugcgggagauggccgacaccgugaucccccagaaggaggaggccgccaucugcggccagauggaccugagccacccccccccccggggccaccuggacgagcugaccaccacccuggagagcaugaccgaggaccugaaccuggacagcccccugacccccgagcugaacgagauccuggacaccuuccugaacgacgagugccugcugcacgccaugcacaucagcaccggccugagcaucuucgacaccagccuguucagcggcggcaagcggcccgccgccaccaagaaggccggccaggccaagaagaagaagggcagcuaccccuacgacgugcccgacuacgccgccaccaacuuuucucugcugaagcaagccggagauguggaggagaaucccggcccuaccuccgccggaaaacugggcuccggcgaaggcagaggaagccuccucacaugcggcgacguggaggagaaccccggcccucuggagggauccucaggcucacuggaaccgggggaaaaacccuacaagugcccggaaugcggcaagagcuucucgaccuccgggaaccugaccgagcaccagcgcacccacaccggagagaaaccguacaagugccccgaaugcgggaaaucguucucagacucgggaaaccucagggugcaccagcggacccacacgggggaaaagccguacaaaugcccggagugcgggaagucauucucccacaagaacgcgcugcagaaccaccaaagaacccacaccggcgaaaaaccguacaagugccccgagugcggaaaguccuucucccgcaacgacacccucaccgaacaccaacgcacccacaccggagaaaagcccuacaagugcccggaaugcggaaagagcuucagccagagggcccaccuggaaagacaccagagaacccacaccggcgaaaagccguacaaaugcccggagugcgggaaguccuucagccggucagacaagcugguccgccaccaaaggacccacacaggagaaaagcccuacaagugcccggaaugcggaaaaucguucagcgaccccggacaccugguccggcaccagaggacccacaccggggagaagccgaccggcaaaaagaccucagcgagcggaucaggaggaggaucagggggggacgcacuggacgacuucgaccuggacaugcugggaucagacgcacuggacgacuucgaccuagacaugcucggaucggacgcacucgacgacuucgaccucgacaugcuaggaucagacgcacuagacgacuucgaccucgacaugcugucgggaggaccgaagaaaaagcggaaggucggaucacaguaccucccggacaccgacgacaggcacagaaucgaagaaaaacgcaagcgcaccuacgaaaccuucaagagcaucaugaaaaagucgccguucucaggaccgaccgaccccagaccgccaccgaggagaauagccgucccgagccgauccuccgcauccgugccgaaaccggcaccgcaacccuacccguucaccucgucccugucgaccaucaacuacgacgaguuccccaccaugguguuccccuccgggcagaucucacaggccucggcacuggcacccgcaccaccgcaagugcugccccaagcaccggcacccgcaccggcgcccgcaauggugucagcgcuggcacaggcaccagcaccggugccaguccucgcaccgggaccgccgcaagcaguggcaccgccggcaccgaaaccgacccaggccggagaagggacccuguccgaggcgcugcugcaacuccaguucgacgacgaggaccugggagcacuccugggaaacuccaccgacccggcaguguucaccgaccucgcaucgguggacaacuccgaguuccaacagcuccugaaccaggggauaccgguggcaccgcacaccaccgaaccgaugcugauggaauacccggaagccaucacccggcucgugaccggagcgcaaagaccgcccgaccccgcgcccgcaccgcugggagcaccgggacuaccgaacgggcugcucucaggggacgaggacuucuccagcaucgcagacauggacuucuccgcccugcugggaucaggaucaggaucacgcgacucccgggaaggaauguuccugccgaagccggaagcaggcagcgcaaucuccgacguguucgaaggccgcgaggucugccagcccaagcgccugcgaccguuccacccgccgggaucaccgugggcaaaccgcccgcuaccggcaucacuggcaccgacacccaccggaccggugcacgaaccggucgggucacugacccccgcaccggucccgcaaccgcuagacccggcaccggcagugaccccggaagcaucgcaccuccuggaggacccggacgaggaaaccucacaggcagugaaggcccugcgggagauggccgacaccgugauaccgcagaaggaggaggccgccaucugcggacaaauggaccugucacacccgcccccgagaggacaccuggacgaacucaccaccacccuggagagcaugaccgaggaccugaaccuggacucaccgcugaccccggagcugaacgaaauccuggacaccuuccugaacgacgagugccugcugcacgcaaugcacaucagcaccgggcugucgaucuucgacaccagccuguucuccggagggaaaagacccgccgccaccaagaaagcgggccaagcaaagaaaaagaagggaucguaccccuacgacgugccggacuacgcaugagcggccgcuuaauuaagcugccuucugcggggcuugccuucuggccaugcccuucuucucucccuugcaccuguaccucuuggucuuugaauaaagccugaguaggaagucuagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 180 - protein, 1713 aa, Artificial Sequence
  source: /note="Description of Artificial Sequence: Synthetic polypeptide"
MAPKKKRKVGIHGVPAAGSSGSSGSLEPGEKPYKCPECGKSFSTSGNLTEHQRTHTGEKPYKCPECGKSFSDSGNLRVHQRTHTGEKPYKCPECGKSFSHKNALQNHQRTHTGEKPYKCPECGKSFSRNDTLTEHQRTHTGEKPYKCPECGKSFSQRAHLERHQRTHTGEKPYKCPECGKSFSRSDKLVRHQRTHTGEKPYKCPECGKSFSDPGHLVRHQRTHTGEKPTGKKTSASGSGGGSGGDALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRLRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFSGGKRPAATKKAGQAKKKKGSYPYDVPDYAATNFSLLKQAGDVEENPGPTSAGKLGSGEGRGSLLTCGDVEENPGPLEGSSGSGSLEPGEKPYKCPECGKSFSRSDHLTNHQRTHTGEKPYKCPECGKSFSTSGSLVRHQRTHTGEKPYKCPECGKSFSQAGHLASHQRTHTGEKPYKCPECGKSFSRSDKLTEHQRTHTGEKPYKCPECGKSFSTSGNLTEHQRTHTGEKPYKCPECGKSFSQSSNLVRHQRTHTGEKPYKCPECGKSFSTHLDLIRHQRTHTGEKPTGKKTSASGSGGGSGGIFKPEELRQALMPTLEALYRQDPESLPFRQPVDPQLLGIPDYFDIVKSPMDLSTIKRKLDTGQYQEPWQYVDDIWLMFNNAWLYNRKTSRVYKYCSKLSEVFEQEIDPVMQSLGYCCGRKLEFSPQTLCCYGKQLCTIPRDATYYSYQNRYHFCEKCFNEIQGESVSLGDDPSQPQTTINKEQFSKRKNDTLDPELFVECTECGRKMHQICVLHHEIIWPAGFVCDGCLKKSARTRKENKFSAKRLPSTRLGTFLENRVNDFLRRQNHPESGEVTVRVVHASDKTVEVKPGMKARFVDSGEMAESFPYRTKALFAFEEIDGVDLCFFGMHVQEYGSDCPPPNQRRVYISYLDSVHFFRPKCLRTAVYHEILIGYLEYVKKLGYTTGHIWACPPSEGDDYIFHCHPPDQKIPKPKRLQEWYKKMLDKAVSERIVHDYKDIFKQATEDRLTSAKELPYFEGDFWPNVLEESIKELEQEEEERKREENTSNESTDVTKGDSKNAKKKNNKKTSKNKSSLSRGNKKKPGMPNVSNDLSQKLYATMEKHKEVFFVIRLIAGPAANSLPPIVDPDPLIPCDLMDGRDAFLTLARDKHLEFSSLRRAQWSTMCMLVELHTQSQDSGGKRPAATKKAGQAKKKKGSYPYDVPDYA

SEQ ID NO: 181 - RNA, 5383 nt, Artificial Sequence
  source: /note="Description of Artificial Sequence: Synthetic polynucleotide"
aggaaauaagagagaaaagaagaguaagaagaaauauaagagccaccauggcccccaagaagaagcggaaggugggcauccacggcgugcccgccgccggcagcagcggaucaucaggcucacuggaaccgggggaaaaacccuacaagugcccggaaugcggcaagagcuucucgaccuccgggaaccugaccgagcaccagcgcacccacaccggagagaaaccguacaagugccccgaaugcgggaaaucguucucagacucgggaaaccucagggugcaccagcggacccacacgggggaaaagccguacaaaugcccggagugcgggaagucauucucccacaagaacgcgcugcagaaccaccaaagaacccacaccggcgaaaaaccguacaagugccccgagugcggaaaguccuucucccgcaacgacacccucaccgaacaccaacgcacccacaccggagaaaagcccuacaagugcccggaaugcggaaagagcuucagccagagggcccaccuggaaagacaccagagaacccacaccggcgaaaagccguacaaaugcccggagugcgggaaguccuucagccggucagacaagcugguccgccaccaaaggacccacacaggagaaaagcccuacaagugcccggaaugcggaaaaucguucagcgaccccggacaccugguccggcaccagaggacccacaccggggagaagccgaccggcaaaaagaccucagcgagcggaucaggaggaggaucagggggggacgcacuggacgacuucgaccuggacaugcugggaucagacgcacuggacgacuucgaccuagacaugcucggaucggacgcacucgacgacuucgaccucgacaugcuaggaucagacgcacuagacgacuucgaccucgacaugcugucgggaggaccgaagaaaaagcggaaggucggaucacaguaccucccggacaccgacgacaggcacagaaucgaagaaaaacgcaagcgcaccuacgaaaccuucaagagcaucaugaaaaagucgccguucucaggaccgaccgaccccagaccgccaccgaggagaauagccgucccgagccgauccuccgcauccgugccgaaaccggcaccgcaacccuacccguucaccucgucccugucgaccaucaacuacgacgaguuccccaccaugguguuccccuccgggcagaucucacaggccucggcacuggcacccgcaccaccgcaagugcugccccaagcaccggcacccgcaccggcgcccgcaauggugucagcgcuggcacaggcaccagcaccggugccaguccucgcaccgggaccgccgcaagcaguggcaccgccggcaccgaaaccgacccaggccggagaagggacccuguccgaggcgcugcugcaacuccaguucgacgacgaggaccugggagcacuccugggaaacuccaccgacccggcaguguucaccgaccucgcaucgguggacaacuccgaguuccaacagcuccugaaccaggggauaccgguggcaccgcacaccaccgaaccgaugcugauggaauacccggaagccaucacccggcucgugaccggagcgcaaagaccgcccgaccccgcgcccgcaccgcugggagcaccgggacuaccgaacgggcugcucucaggggacgaggacuucuccagcaucgcagacauggacuucuccgcccugcugggaucaggaucaggaucacgcgacucccgggaaggaauguuccugccgaagccggaagcaggcagcgcaaucuccgacguguucgaaggccgcgaggucugccagcccaagcgccugcgaccguuccacccgccgggaucaccgugggcaaaccgcccgcuaccggcaucacuggcaccgacacccaccggaccggugcacgaaccggucgggucacugacccccgcaccggucccgcaaccgcuagacccggcaccggcagugaccccggaagcaucgcaccuccuggaggacccggacgaggaaaccucacaggcagugaaggcccugcgggagauggccgacaccgugauaccgcagaaggaggaggccgccaucugcggacaaauggaccugucacacccgcccccgagaggacaccuggacgaacucaccaccacccuggagagcaugaccgaggaccugaaccuggacucaccgcugaccccggagcugaacgaaauccuggacaccuuccugaacgacgagugccugcugcacgcaaugcacaucagcaccgggcugucgaucuucgacaccagccuguucuccggagggaaaagacccgccgccaccaagaaagcgggccaagcaaagaaaaagaagggaucguaccccuacgacgugccggacuacgcagccaccaacuuuucucugcugaagcaagccggagauguggaggagaaucccggcccuaccuccgccggaaaacugggcuccggcgaaggcagaggaagccuccucacaugcggcgacguggaggagaaccccggcccucuggagggauccucaggcucaggaucccuggaaccgggcgagaagccauacaagugcccagagugcggcaaaagcuucagccgcagcgaccaucugaccaaucaccaacgcacccauaccggugagaagccguacaaaugcccagagugcgguaagagcuuuaguaccaguggcagucugguucgucaucagcgcacgcacacgggcgaaaaaccauacaaaugcccggagugcggcaaaagcuuuagccaagccggucaucuggcgagccaucaacguacgcacaccggcgagaagccguauaaauguccggagugcgguaagagcuuuagccguagcgauaaacugaccgaacaccaacguacgcauacgggcgagaaaccauauaaauguccagaguguggcaagaguuucagcaccagcggcaaucugaccgagcaucaacguacccauaccggugaaaagccauauaaauguccagaaugcgguaagaguuuuagucagagcaguaaucuggugcgccaucagcguacccacacgggugagaaaccauauaaguguccggaaugcggcaagaguuuuagcacccaucuggaucugauccgucaucagcgcacccacaccggugaaaaaccaaccggcaagaaaaccagugcuagcggcagcggcggcggcagcggcggcaucuucaagcccgaggagcugcggcaggcccugaugcccacccuggaggcccuguaccggcaggaccccgagagccugcccuuccggcagcccguggacccccagcugcugggcauccccgacuacuucgacaucgugaaaucccccauggaccugagcaccaucaagcggaagcuggacaccggccaguaccaggagcccuggcaguacguggacgacaucuggcugauguucaacaacgccuggcuguacaaccggaaaaccagccggguguacaaguacugcagcaagcugagcgagguguucgagcaggagaucgaccccgugaugcagagccugggcuacugcugcggccggaagcuggaguucagcccccagacccugugcugcuacggcaagcagcugugcaccaucccccgggacgccaccuacuacagcuaccagaaccgguaccacuucugcgagaagugcuucaacgagauccagggcgagagcgugagccugggcgacgaccccagccagccccagaccaccaucaacaaggagcaguucagcaagcggaagaacgacacccuggaccccgagcuguucguggagugcaccgagugcggccggaagaugcaccagaucugcgugcugcaccacgagaucaucuggcccgccggcuucgugugcgacggcugccugaagaaauccgcccggacccggaaggagaacaaguucagcgccaagcggcugcccagcacccggcugggcaccuuccuggagaaccgggugaacgacuuccugcggcggcagaaccaccccgagagcggcgaggugaccgugcggguggugcacgccagcgacaagaccguggaggugaagcccggcaugaaggcccgguucguggacagcggcgagauggccgagagcuuccccuaccggaccaaggcccuguucgccuucgaggagaucgacggcguggaccugugcuucuucggcaugcacgugcaggaguacggcagcgacugccccccccccaaccagcggcggguguacaucagcuaccuggacagcgugcacuucuuccggcccaagugccugcggaccgccguguaccacgagauccugaucggcuaccuggaguacgugaagaagcugggcuacaccaccggccacaucugggccugcccccccagcgagggcgacgacuacaucuuccacugccacccccccgaccagaagauccccaagcccaagcggcugcaggagugguacaagaagaugcuggacaaggccgugagcgagcggaucgugcacgacuacaaggacaucuucaagcaggccaccgaggaccggcugaccagcgccaaggagcugcccuacuucgagggcgacuucuggcccaacgugcuggaggagagcaucaaggagcuggagcaggaggaggaggagcggaagcgggaggagaacaccagcaacgagagcaccgacgugaccaagggcgacagcaagaacgccaagaagaagaacaacaagaaaaccagcaagaacaagagcagccugagccggggcaacaagaagaagcccggcaugcccaacgugagcaacgaccugagccagaagcuguacgccaccauggagaagcacaaggagguguucuucgugauccggcugaucgccggccccgccgccaacagccugccccccaucguggaccccgacccccugauccccugcgaccugauggacggccgggacgccuuccugacccuggcccgggacaagcaccuggaguucagcagccugcggcgggcccaguggagcaccaugugcaugcugguggagcugcacacccagagccaggacagcggcggcaagcggcccgccgccaccaagaaggccggccaggccaagaagaagaagggcagcuaccccuacgacgugcccgacuacgccugagcggccgcuuaauuaagcugccuucugcggggcuugccuucuggccaugcccuucuucucucccuugcaccuguaccucuuggucuuugaauaaagccugaguaggaagucuagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 182 - protein, 1708 aa, Artificial Sequence
  source: /note="Description of Artificial Sequence: Synthetic polypeptide"
MAPKKKRKVGIHGVPAAGSSGSLEPGEKPYKCPECGKSFSRSDHLTNHQRTHTGEKPYKCPECGKSFSTSGSLVRHQRTHTGEKPYKCPECGKSFSQAGHLASHQRTHTGEKPYKCPECGKSFSRSDKLTEHQRTHTGEKPYKCPECGKSFSTSGNLTEHQRTHTGEKPYKCPECGKSFSQSSNLVRHQRTHTGEKPYKCPECGKSFSTHLDLIRHQRTHTGEKPTGKKTSASGSGGGSGGIFKPEELRQALMPTLEALYRQDPESLPFRQPVDPQLLGIPDYFDIVKSPMDLSTIKRKLDTGQYQEPWQYVDDIWLMFNNAWLYNRKTSRVYKYCSKLSEVFEQEIDPVMQSLGYCCGRKLEFSPQTLCCYGKQLCTIPRDATYYSYQNRYHFCEKCFNEIQGESVSLGDDPSQPQTTINKEQFSKRKNDTLDPELFVECTECGRKMHQICVLHHEIIWPAGFVCDGCLKKSARTRKENKFSAKRLPSTRLGTFLENRVNDFLRRQNHPESGEVTVRVVHASDKTVEVKPGMKARFVDSGEMAESFPYRTKALFAFEEIDGVDLCFFGMHVQEYGSDCPPPNQRRVYISYLDSVHFFRPKCLRTAVYHEILIGYLEYVKKLGYTTGHIWACPPSEGDDYIFHCHPPDQKIPKPKRLQEWYKKMLDKAVSERIVHDYKDIFKQATEDRLTSAKELPYFEGDFWPNVLEESIKELEQEEEERKREENTSNESTDVTKGDSKNAKKKNNKKTSKNKSSLSRGNKKKPGMPNVSNDLSQKLYATMEKHKEVFFVIRLIAGPAANSLPPIVDPDPLIPCDLMDGRDAFLTLARDKHLEFSSLRRAQWSTMCMLVELHTQSQDSGGKRPAATKKAGQAKKKKGSYPYDVPDYAATNFSLLKQAGDVEENPGPTSAGKLGSGEGRGSLLTCGDVEENPGPLEGSSGSLEPGEKPYKCPECGKSFSTSGNLTEHQRTHTGEKPYKCPECGKSFSDSGNLRVHQRTHTGEKPYKCPECGKSFSHKNALQNHQRTHTGEKPYKCPECGKSFSRNDTLTEHQRTHTGEKPYKCPECGKSFSQRAHLERHQRTHTGEKPYKCPECGKSFSRSDKLVRHQRTHTGEKPYKCPECGKSFSDPGHLVRHQRTHTGEKPTGKKTSASGSGGGSGGDALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRLRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFSGGKRPAATKKAGQAKKKKGSYPYDVPDYA

SEQ ID NO: 183 - RNA, 5368 nt, Artificial Sequence
  source: /note="Description of Artificial Sequence: Synthetic polynucleotide"
aggaaauaagagagaaaagaagaguaagaagaaauauaagagccaccauggcccccaagaagaagcggaaggugggcauccacggcgugcccgccgccggcagcagcggaucccuggaaccgggcgagaagccauacaagugcccagagugcggcaaaagcuucagccgcagcgaccaucugaccaaucaccaacgcacccauaccggugagaagccguacaaaugcccagagugcgguaagagcuuuaguaccaguggcagucugguucgucaucagcgcacgcacacgggcgaaaaaccauacaaaugcccggagugcggcaaaagcuuuagccaagccggucaucuggcgagccaucaacguacgcacaccggcgagaagccguauaaauguccggagugcgguaagagcuuuagccguagcgauaaacugaccgaacaccaacguacgcauacgggcgagaaaccauauaaauguccagaguguggcaagaguuucagcaccagcggcaaucugaccgagcaucaacguacccauaccggugaaaagccauauaaauguccagaaugcgguaagaguuuuagucagagcaguaaucuggugcgccaucagcguacccacacgggugagaaaccauauaaguguccggaaugcggcaagaguuuuagcacccaucuggaucugauccgucaucagcgcacccacaccggugaaaaaccaaccggcaagaaaaccagugcuagcggcagcggcggcggcagcggcggcaucuucaagcccgaggagcugcggcaggcccugaugcccacccuggaggcccuguaccggcaggaccccgagagccugcccuuccggcagcccguggacccccagcugcugggcauccccgacuacuucgacaucgugaaaucccccauggaccugagcaccaucaagcggaagcuggacaccggccaguaccaggagcccuggcaguacguggacgacaucuggcugauguucaacaacgccuggcuguacaaccggaaaaccagccggguguacaaguacugcagcaagcugagcgagguguucgagcaggagaucgaccccgugaugcagagccugggcuacugcugcggccggaagcuggaguucagcccccagacccugugcugcuacggcaagcagcugugcaccaucccccgggacgccaccuacuacagcuaccagaaccgguaccacuucugcgagaagugcuucaacgagauccagggcgagagcgugagccugggcgacgaccccagccagccccagaccaccaucaacaaggagcaguucagcaagcggaagaacgacacccuggaccccgagcuguucguggagugcaccgagugcggccggaagaugcaccagaucugcgugcugcaccacgagaucaucuggcccgccggcuucgugugcgacggcugccugaagaaauccgcccggacccggaaggagaacaaguucagcgccaagcggcugcccagcacccggcugggcaccuuccuggagaaccgggugaacgacuuccugcggcggcagaaccaccccgagagcggcgaggugaccgugcggguggugcacgccagcgacaagaccguggaggugaagcccggcaugaaggcccgguucguggacagcggcgagauggccgagagcuuccccuaccggaccaaggcccuguucgccuucgaggagaucgacggcguggaccugugcuucuucggcaugcacgugcaggaguacggcagcgacugccccccccccaaccagcggcggguguacaucagcuaccuggacagcgugcacuucuuccggcccaagugccugcggaccgccguguaccacgagauccugaucggcuaccuggaguacgugaagaagcugggcuacaccaccggccacaucugggccugcccccccagcgagggcgacgacuacaucuuccacugccacccccccgaccagaagauccccaagcccaagcggcugcaggagugguacaagaagaugcuggacaaggccgugagcgagcggaucgugcacgacuacaaggacaucuucaagcaggccaccgaggaccggcugaccagcgccaaggagcugcccuacuucgagggcgacuucuggcccaacgugcuggaggagagcaucaaggagcuggagcaggaggaggaggagcggaagcgggaggagaacaccagcaacgagagcaccgacgugaccaagggcgacagcaagaacgccaagaagaagaacaacaagaaaaccagcaagaacaagagcagccugagccggggcaacaagaagaagcccggcaugcccaacgugagcaacgaccugagccagaagcuguacgccaccauggagaagcacaaggagguguucuucgugauccggcugaucgccggccccgccgccaacagccugccccccaucguggaccccgacccccugauccccugcgaccugauggacggccgggacgccuuccugacccuggcccgggacaagcaccuggaguucagcagccugcggcgggcccaguggagcaccaugugcaugcugguggagcugcacacccagagccaggacagcggcggcaagcggcccgccgccaccaagaaggccggccaggccaagaagaagaagggcagcuaccccuacgacgugcccgacuacgccgccaccaacuuuucucugcugaagcaagccggagauguggaggagaaucccggcccuaccuccgccggaaaacugggcuccggcgaaggcagaggaagccuccucacaugcggcgacguggaggagaaccccggcccucuggagggauccucaggcucacuggaaccgggggaaaaacccuacaagugcccggaaugcggcaagagcuucucgaccuccgggaaccugaccgagcaccagcgcacccacaccggagagaaaccguacaagugccccgaaugcgggaaaucguucucagacucgggaaaccucagggugcaccagcggacccacacgggggaaaagccguacaaaugcccggagugcgggaagucauucucccacaagaacgcgcugcagaaccaccaaagaacccacaccggcgaaaaaccguacaagugccccgagugcggaaaguccuucucccgcaacgacacccucaccgaacaccaacgcacccacaccggagaaaagcccuacaagugcccggaaugcggaaagagcuucagccagagggcccaccuggaaagacaccagagaacccacaccggcgaaaagccguacaaaugcccggagugcgggaaguccuucagccggucagacaagcugguccgccaccaaaggacccacacaggagaaaagcccuacaagugcccggaaugcggaaaaucguucagcgaccccggacaccugguccggcaccagaggacccacaccggggagaagccgaccggcaaaaagaccucagcgagcggaucaggaggaggaucagggggggacgcacuggacgacuucgaccuggacaugcugggaucagacgcacuggacgacuucgaccuagacaugcucggaucggacgcacucgacgacuucgaccucgacaugcuaggaucagacgcacuagacgacuucgaccucgacaugcugucgggaggaccgaagaaaaagcggaaggucggaucacaguaccucccggacaccgacgacaggcacagaaucgaagaaaaacgcaagcgcaccuacgaaaccuucaagagcaucaugaaaaagucgccguucucaggaccgaccgaccccagaccgccaccgaggagaauagccgucccgagccgauccuccgcauccgugccgaaaccggcaccgcaacccuacccguucaccucgucccugucgaccaucaacuacgacgaguuccccaccaugguguuccccuccgggcagaucucacaggccucggcacuggcacccgcaccaccgcaagugcugccccaagcaccggcacccgcaccggcgcccgcaauggugucagcgcuggcacaggcaccagcaccggugccaguccucgcaccgggaccgccgcaagcaguggcaccgccggcaccgaaaccgacccaggccggagaagggacccuguccgaggcgcugcugcaacuccaguucgacgacgaggaccugggagcacuccugggaaacuccaccgacccggcaguguucaccgaccucgcaucgguggacaacuccgaguuccaacagcuccugaaccaggggauaccgguggcaccgcacaccaccgaaccgaugcugauggaauacccggaagccaucacccggcucgugaccggagcgcaaagaccgcccgaccccgcgcccgcaccgcugggagcaccgggacuaccgaacgggcugcucucaggggacgaggacuucuccagcaucgcagacauggacuucuccgcccugcugggaucaggaucaggaucacgcgacucccgggaaggaauguuccugccgaagccggaagcaggcagcgcaaucuccgacguguucgaaggccgcgaggucugccagcccaagcgccugcgaccguuccacccgccgggaucaccgugggcaaaccgcccgcuaccggcaucacuggcaccgacacccaccggaccggugcacgaaccggucgggucacugacccccgcaccggucccgcaaccgcuagacccggcaccggcagugaccccggaagcaucgcaccuccuggaggacccggacgaggaaaccucacaggcagugaaggcccugcgggagauggccgacaccgugauaccgcagaaggaggaggccgccaucugcggacaaauggaccugucacacccgcccccgagaggacaccuggacgaacucaccaccacccuggagagcaugaccgaggaccugaaccuggacucaccgcugaccccggagcugaacgaaauccuggacaccuuccugaacgacgagugccugcugcacgcaaugcacaucagcaccgggcugucgaucuucgacaccagccuguucuccggagggaaaagacccgccgccaccaagaaagcgggccaagcaaagaaaaagaagggaucguaccccuacgacgugccggacuacgcaugagcggccgcuuaauuaagcugccuucugcggggcuugccuucuggccaugcccuucuucucucccuugcaccuguaccucuuggucuuugaauaaagccugaguaggaagucuagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 184 - protein, 1378 aa, Artificial Sequence
  source: /note="Description of Artificial Sequence: Synthetic polypeptide"
MAPKKKRKVGIHGVPAAGSSGSHMVDLRTLGYSQQQQEKIKPKVRSTVAQHHEALVGHGFTHAHIVALSQHPAALGTVAVKYQDMIAALPEATHEAIVGVGKRGAGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASHDGGKQALETVQRLLPVLCQAHGLTPEQVVAIASNNGGKQALETVQRLLPVLCQAHGLTPEQVVAIASNGGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNIGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNIGGKQALETVQRLLPVLCQAHGLTPEQVVAIASNNGGRPALESIVAQLSRPDPALAALTNDHLVALACLGGRPALDAVKKGLPHAPALIKRTNRRIPERTSHRVASGSGGGSGGDALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRLRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFSGGKRPAATKKAGQAKKKKGSYPYDVPDYA

SEQ ID NO: 185 - DNA, 4378 bp, Artificial Sequence
  source: /note="Description of Artificial Sequence: Synthetic polynucleotide"
aggaaataagagagaaaagaagagtaagaagaaatataagagccaccatggcccccaagaagaagcggaaggtgggcatccacggcgtgcccgccgccggcagcagcggatcccatatggttgatctgcgtaccctgggttatagccagcagcagcaagaaaaaatcaaaccgaaagttcgtagcaccgttgcacagcatcatgaagcactggttggtcatggttttacccatgcacatattgttgcactgagccagcatccggcagcactgggcaccgttgcagttaaatatcaggatatgattgcagcactgccggaagcaacccatgaagcaattgttggtgttggtaaacgcggagctggtgcacgtgccctggaagcactgctgaccgttgccggtgaactgcgtggtccgcctctgcagctggataccggtcagctgctgaaaattgcaaaacgtggtggtgttaccgcagttgaagcagttcatgcatggcgtaatgcactgaccggtgcaccgctgaatctgacaccggaacaggttgttgcaattgccagccatgatggtggcaaacaggcactggaaaccgttcagcgtctgctgccggttctgtgtcaggcacatggtctgacccctgaacaggtggtggccattgcaagcaataatggcggtaaacaagccctggaaacagtgcagcgcctgttaccggtgctgtgccaggcccatggcttaactccggaacaggtggtagcgatcgcatcaaacaatggaggtaaacaggccttagaaaccgtacagcgcttactgccggtgttatgccaggcgcacggcctgacgccagaacaggtagtggcaatcgcctcacatgacggtggaaaacaggcgttagagacagtccagcgcctgctgcctgtattatgtcaagcccatggcctgaccccagagcaagttgttgcgattgcaagtaataatgggggtaaacaggcacttgagacagttcaacgtttactgcctgtactgtgccaagctcacggtctgactccggaacaagtcgtcgcgattgcgagtaatggtggtggcaaacaagcattagaaacggtgcaacgcctgctgccagttctttgccaggctcacggtttaacccctgagcaggttgtagctattgcgagtaacaatggtggtaagcaggcgttggaaactgtgcaaagactgctgcccgtgttgtgccaagcacatggtttaaccccagaacaagtcgtagcaatcgcaagcaataatggtggcaagcaagcgcttgaaacagtacagcgtttattaccggtactttgtcaggcccacggtcttacaccagaacaagttgtggccatagccagtaacattggcggaaagcaggctctggaaacggtacaacgtctgttacctgttctgtgtcaagcgcacggattaacacctgaacaagtagttgccattgcgtcaaataatggaggcaagcaggccttggagacagtgcagagattactgccagtgttgtgtcaggctcatggccttacacccgagcaggtcgtggcaattgcatctaacaatggcggtaagcaagctttagagactgttcagagactgcttcctgtcctgtgccaggcacacggacttacgcctgagcaagtggttgcaatcgcctctcatgatggtggtaagcaagcactggaaactgtccaacgcttacttccggtgctttgtcaagcacacggcttaacgccagagcaggtcgtcgccatagccagcaatataggtggtaaacaggcccttgaaacggtccaaagacttctgccggtcctttgccaagcgcatgggctgacacctgagcaggtagtcgcgattgcctcaaataatggtgggaagcaggcattagaaacagttcaaagattattaccagtcctgtgtcaggcgcatgggttaaccccagagcaggtagttgcaatagcatccaacaatggcggaaaacaagcgttggaaacggttcagcggttattgcctgttttgtgccaggcgcatggtttgacacccgagcaagtggtagccatagcctcaaataatgggggtaaacaagctttggagacagtacaacggctgcttccagttttatgtcaggcccatggattgacgcctgaacaagttgtcgctatcgcaagtaatatcggtggtaaacaagcgcttgaaaccgttcaacgccttctgcctgtgctttgtcaggcacatggattaacacccgaacaggttgtcgcgatagcttcaaacaatggtggtcgtccggcactggaaagcattgttgcacagctgagccgtcctgatccggcactggcagcactgaccaatgatcatctggttgcactggcatgtctgggtggtcgccctgccctggatgcagttaaaaaaggtctgccgcatgcaccggcactgattaaacgtaccaatcgtcgtattccggaacgtaccagccatcgtgttgctagcggcagcggcggcggcagcggcggcgacgccctggacgacttcgacctggacatgctgggcagcgacgccctggacgacttcgacctggacatgctgggcagcgacgccctggacgacttcgacctggacatgctgggcagcgacgccctggacgacttcgacctggacatgctgagcggcggccccaagaagaagcggaaggtgggcagccagtacctgcccgacaccgacgaccggcaccggatcgaggagaagcggaagcggacctacgagaccttcaagagcatcatgaagaaatcccccttcagcggccccaccgacccccggccccccccccggcggatcgccgtgcccagccggagcagcgccagcgtgcccaagcccgccccccagccctaccccttcaccagcagcctgagcaccatcaactacgacgagttccccaccatggtgttccccagcggccagatcagccaggccagcgccctggcccccgcccccccccaggtgctgccccaggcccccgcccccgcccccgcccccgccatggtgagcgccctggcccaggcccccgcccccgtgcccgtgctggcccccggccccccccaggccgtggccccccccgcccccaagcccacccaggccggcgagggcaccctgagcgaggccctgctgcagctgcagttcgacgacgaggacctgggcgccctgctgggcaacagcaccgaccccgccgtgttcaccgacctggccagcgtggacaacagcgagttccagcagctgctgaaccagggcatccccgtggccccccacaccaccgagcccatgctgatggagtaccccgaggccatcacccggctggtgaccggcgcccagcggccccccgaccccgcccccgcccccctgggcgcccccggcctgcccaacggcctgctgagcggcgacgaggacttcagcagcatcgccgacatggacttcagcgccctgctgggcagcggcagcggcagccgggacagccgggagggcatgttcctgcccaagcccgaggccggcagcgccatcagcgacgtgttcgagggccgggaggtgtgccagcccaagcggctccggcccttccacccccccggcagcccctgggccaaccggcccctgcccgccagcctggcccccacccccaccggccccgtgcacgagcccgtgggcagcctgacccccgcccccgtgccccagcccctggaccccgcccccgccgtgacccccgaggccagccacctgctggaggaccccgacgaggagaccagccaggccgtgaaggccctgcgggagatggccgacaccgtgatcccccagaaggaggaggccgccatctgcggccagatggacctgagccacccccccccccggggccacctggacgagctgaccaccaccctggagagcatgaccgaggacctgaacctggacagccccctgacccccgagctgaacgagatcctggacaccttcctgaacgacgagtgcctgctgcacgccatgcacatcagcaccggcctgagcatcttcgacaccagcctgttcagcggcggcaagcggcccgccgccaccaagaaggccggccaggccaagaagaagaagggcagctacccctacgacgtgcccgactacgcctgagcggccgcttaattaagctgccttctgcggggcttgccttctggccatgcccttcttctctcccttgcacctgtacctcttggtctttgaataaagcctgagtaggaagtctagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 186 - protein, 802 aa, Artificial Sequence
  source: /note="Description of Artificial Sequence: Synthetic polypeptide"
GSHMVDLRTLGYSQQQQEKIKPKVRSTVAQHHEALVGHGFTHAHIVALSQHPAALGTVAVKYQDMIAALPEATHEAIVGVGKRGAGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASHDGGKQALETVQRLLPVLCQAHGLTPEQVVAIASNNGGKQALETVQRLLPVLCQAHGLTPEQVVAIASNGGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNIGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNIGGKQALETVQRLLPVLCQAHGLTPEQVVAIASNNGGRPALESIVAQLSRPDPALAALTNDHLVALACLGGRPALDAVKKGLPHAPALIKRTNRRIPERTSHRVAS

SEQ ID NO: 187 - protein, 1378 aa, Artificial Sequence
  source: /note="Description of Artificial Sequence: Synthetic polypeptide"
MAPKKKRKVGIHGVPAAGSSGSHMVDLRTLGYSQQQQEKIKPKVRSTVAQHHEALVGHGFTHAHIVALSQHPAALGTVAVKYQDMIAALPEATHEAIVGVGKRGAGARALEALLTVAGELRGPPLQLDTGQLLKIAKRGGVTAVEAVHAWRNALTGAPLNLTPEQVVAIASNGGGKQALETVQRLLPVLCQAHGLTPEQVVAIASNGGGKQALETVQRLLPVLCQAHGLTPEQVVAIASHDGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNGGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASHDGGKQALETVQRLLPVLCQAHGLTPEQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASNNGGRPALESIVAQLSRPDPALAALTNDHLVALACLGGRPALDAVKKGLPHAPALIKRTNRRIPERTSHRVASGSGGGSGGDALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRLRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFSGGKRPAATKKAGQAKKKKGSYPYDVPDYA

SEQ ID NO: 188 - DNA, 4378 bp, Artificial Sequence
  source: /note="Description of Artificial Sequence: Synthetic polynucleotide"
aggaaataagagagaaaagaagagtaagaagaaatataagagccaccatggcccccaagaagaagcggaaggtgggcatccacggcgtgcccgccgccggcagcagcggatcccatatggttgatctgcgtaccctgggttatagccagcagcagcaagaaaaaatcaaaccgaaagttcgtagcaccgttgcacagcatcatgaagcactggttggtcatggttttacccatgcacatattgttgcactgagccagcatccggcagcactgggcaccgttgcagttaaatatcaggatatgattgcagcactgccggaagcaacccatgaagcaattgttggtgttggtaaacgcggagctggtgcacgtgccctggaagcactgctgaccgttgccggtgaactgcgtggtccgcctctgcagctggataccggtcagctgctgaaaattgcaaaacgtggtggtgttaccgcagttgaagcagttcatgcatggcgtaatgcactgaccggtgcaccgctgaatctgacaccggaacaggttgttgcaattgccagcaatggtggtggcaaacaggcactggaaaccgttcagcgtctgctgccggttctgtgtcaggcacatggtctgacccctgaacaggtggtggccattgcaagcaatggcggcggtaaacaagccctggaaacagtgcagcgcctgttaccggtgctgtgccaggcccatggcttaactccggaacaggtggtagcgatcgcatcacatgatggaggtaaacaggccttagaaaccgtacagcgcttactgccggtgttatgccaggcgcacggcctgacgccagaacaggtagtggcaatcgcctcaaataatggtggaaaacaggcgttagagacagtccagcgcctgctgcctgtattatgtcaagcccatggcctgaccccagagcaagttgttgcgattgcaagtaacaatgggggtaaacaggcacttgagacagttcaacgtttactgcctgtactgtgccaagctcacggtctgactccggaacaagtcgtcgcgattgcgagtaataatggtggcaaacaagcattagaaacggtgcaacgcctgctgccagttctttgccaggctcacggtttaacccctgagcaggttgtagctattgcgagtaacaatggtggtaagcaggcgttggaaactgtgcaaagactgctgcccgtgttgtgccaagcacatggtttaaccccagaacaagtcgtagcaatcgcaagcaatgggggtggcaagcaagcgcttgaaacagtacagcgtttattaccggtactttgtcaggcccacggtcttacaccagaacaagttgtggccatagccagtaataatggcggaaagcaggctctggaaacggtacaacgtctgttacctgttctgtgtcaagcgcacggattaacacctgaacaagtagttgccattgcgtcaaacaatggaggcaagcaggccttggagacagtgcagagattactgccagtgttgtgtcaggctcatggccttacacccgagcaggtcgtggcaattgcatctaataatggcggtaagcaagctttagagactgttcagagactgcttcctgtcctgtgccaggcacacggacttacgcctgagcaagtggttgcaatcgcctctcatgatggtggtaagcaagcactggaaactgtccaacgcttacttccggtgctttgtcaagcacacggcttaacgccagagcaggtcgtcgccatagccagcaacaatggtggtaaacaggcccttgaaacggtccaaagacttctgccggtcctttgccaagcgcatgggctgacacctgagcaggtagtcgcgattgcctcacatgacggtgggaagcaggcattagaaacagttcaaagattattaccagtcctgtgtcaggcgcatgggttaaccccagagcaggtagttgcaatagcatcccatgatggcggaaaacaagcgttggaaacggttcagcggttattgcctgttttgtgccaggcgcatggtttgacacccgagcaagtggtagccatagcctcacatgacgggggtaaacaagctttggagacagtacaacggctgcttccagttttatgtcaggcccatggattgacgcctgaacaagttgtcgctatcgcaagtaacattggtggtaaacaagcgcttgaaaccgttcaacgccttctgcctgtgctttgtcaggcacatggattaacacccgaacaggttgtcgcgatagcttcaaacaatggtggtcgtccggcactggaaagcattgttgcacagctgagccgtcctgatccggcactggcagcactgaccaatgatcatctggttgcactggcatgtctgggtggtcgccctgccctggatgcagttaaaaaaggtctgccgcatgcaccggcactgattaaacgtaccaatcgtcgtattccggaacgtaccagccatcgtgttgctagcggcagcggcggcggcagcggcggcgacgccctggacgacttcgacctggacatgctgggcagcgacgccctggacgacttcgacctggacatgctgggcagcgacgccctggacgacttcgacctggacatgctgggcagcgacgccctggacgacttcgacctggacatgctgagcggcggccccaagaagaagcggaaggtgggcagccagtacctgcccgacaccgacgaccggcaccggatcgaggagaagcggaagcggacctacgagaccttcaagagcatcatgaagaaatcccccttcagcggccccaccgacccccggccccccccccggcggatcgccgtgcccagccggagcagcgccagcgtgcccaagcccgccccccagccctaccccttcaccagcagcctgagcaccatcaactacgacgagttccccaccatggtgttccccagcggccagatcagccaggccagcgccctggcccccgcccccccccaggtgctgccccaggcccccgcccccgcccccgcccccgccatggtgagcgccctggcccaggcccccgcccccgtgcccgtgctggcccccggccccccccaggccgtggccccccccgcccccaagcccacccaggccggcgagggcaccctgagcgaggccctgctgcagctgcagttcgacgacgaggacctgggcgccctgctgggcaacagcaccgaccccgccgtgttcaccgacctggccagcgtggacaacagcgagttccagcagctgctgaaccagggcatccccgtggccccccacaccaccgagcccatgctgatggagtaccccgaggccatcacccggctggtgaccggcgcccagcggccccccgaccccgcccccgcccccctgggcgcccccggcctgcccaacggcctgctgagcggcgacgaggacttcagcagcatcgccgacatggacttcagcgccctgctgggcagcggcagcggcagccgggacagccgggagggcatgttcctgcccaagcccgaggccggcagcgccatcagcgacgtgttcgagggccgggaggtgtgccagcccaagcggctccggcccttccacccccccggcagcccctgggccaaccggcccctgcccgccagcctggcccccacccccaccggccccgtgcacgagcccgtgggcagcctgacccccgcccccgtgccccagcccctggaccccgcccccgccgtgacccccgaggccagccacctgctggaggaccccgacgaggagaccagccaggccgtgaaggccctgcgggagatggccgacaccgtgatcccccagaaggaggaggccgccatctgcggccagatggacctgagccacccccccccccggggccacctggacgagctgaccaccaccctggagagcatgaccgaggacctgaacctggacagccccctgacccccgagctgaacgagatcctggacaccttcctgaacgacgagtgcctgctgcacgccatgcacatcagcaccggcctgagcatcttcgacaccagcctgttcagcggcggcaagcggcccgccgccaccaagaaggccggccaggccaagaagaagaagggcagctacccctacgacgtgcccgactacgcctgagcggccgcttaattaagctgccttctgcggggcttgccttctggccatgcccttcttctctcccttgcacctgtacctcttggtctttgaataaagcctgagtaggaagtctagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 189 - protein, 802 aa, Artificial Sequence
  source: /note="Description of Artificial Sequence: Synthetic polypeptide"
GSHMVDLRTLGYSQQQQEKIKPKVRSTVAQHHEALVGHGFTHAHIVALSQHPAALGTVAVKYQDMIAALPEATHEAIVGVGKRGAGARALEALLTVAGELRGPPLQLDTGQLLKIAKRGGVTAVEAVHAWRNALTGAPLNLTPEQVVAIASNGGGKQALETVQRLLPVLCQAHGLTPEQVVAIASNGGGKQALETVQRLLPVLCQAHGLTPEQVVAIASHDGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNGGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASHDGGKQALETVQRLLPVLCQAHGLTPEQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASNNGGRPALESIVAQLSRPDPALAALTNDHLVALACLGGRPALDAVKKGLPHAPALIKRTNRRIPERTSHRVAS

SEQ ID NO: 190 - protein, 1378 aa, Artificial Sequence
  source: /note="Description of Artificial Sequence: Synthetic polypeptide"
MAPKKKRKVGIHGVPAAGSSGSHMVDLRTLGYSQQQQEKIKPKVRSTVAQHHEALVGHGFTHAHIVALSQHPAALGTVAVKYQDMIAALPEATHEAIVGVGKRGAGARALEALLTVAGELRGPPLQLDTGQLLKIAKRGGVTAVEAVHAWRNALTGAPLNLTPEQVVAIASNNGGKQALETVQRLLPVLCQAHGLTPEQVVAIASNGGGKQALETVQRLLPVLCQAHGLTPEQVVAIASNGGGKQALETVQRLLPVLCQAHGLTPEQVVAIASNGGGKQALETVQRLLPVLCQAHGLTPEQVVAIASNNGGKQALETVQRLLPVLCQAHGLTPEQVVAIASNIGGKQALETVQRLLPVLCQAHGLTPEQVVAIASNIGGKQALETVQRLLPVLCQAHGLTPEQVVAIASNIGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNIGGKQALETVQRLLPVLCQAHGLTPEQVVAIASNIGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASNNGGKQALETVQRLLPVLCQAHGLTPEQVVAIASNIGGRPALESIVAQLSRPDPALAALTNDHLVALACLGGRPALDAVKKGLPHAPALIKRTNRRIPERTSHRVASGSGGGSGGDALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRLRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFSGGKRPAATKKAGQAKKKKGSYPYDVPDYA

SEQ ID NO: 191 - DNA, 4378 bp, Artificial Sequence
  source: /note="Description of Artificial Sequence: Synthetic polynucleotide"
aggaaataagagagaaaagaagagtaagaagaaatataagagccaccatggcccccaagaagaagcggaaggtgggcatccacggcgtgcccgccgccggcagcagcggatcccatatggttgatctgcgtaccctgggttatagccagcagcagcaagaaaaaatcaaaccgaaagttcgtagcaccgttgcacagcatcatgaagcactggttggtcatggttttacccatgcacatattgttgcactgagccagcatccggcagcactgggcaccgttgcagttaaatatcaggatatgattgcagcactgccggaagcaacccatgaagcaattgttggtgttggtaaacgcggagctggtgcacgtgccctggaagcactgctgaccgttgccggtgaactgcgtggtccgcctctgcagctggataccggtcagctgctgaaaattgcaaaacgtggtggtgttaccgcagttgaagcagttcatgcatggcgtaatgcactgaccggtgcaccgctgaatctgacaccggaacaggttgttgcaattgccagcaataatggtggcaaacaggcactggaaaccgttcagcgtctgctgccggttctgtgtcaggcacatggtctgacccctgaacaggtggtggccattgcaagcaatggtggcggtaaacaagccctggaaacagtgcagcgcctgttaccggtgctgtgccaggcccatggcttaactccggaacaggtggtagcgatcgcatcaaatggcggaggtaaacaggccttagaaaccgtacagcgcttactgccggtgttatgccaggcgcacggcctgacgccagaacaggtagtggcaatcgcctcaaatgggggtggaaaacaggcgttagagacagtccagcgcctgctgcctgtattatgtcaagcccatggcctgaccccagagcaagttgttgcgattgcaagtaacaatgggggtaaacaggcacttgagacagttcaacgtttactgcctgtactgtgccaagctcacggtctgactccggaacaagtcgtcgcgattgcgagtaacattggtggcaaacaagcattagaaacggtgcaacgcctgctgccagttctttgccaggctcacggtttaacccctgagcaggttgtagctattgcgagtaatatcggtggtaagcaggcgttggaaactgtgcaaagactgctgcccgtgttgtgccaagcacatggtttaaccccagaacaagtcgtagcaatcgcaagcaatataggtggcaagcaagcgcttgaaacagtacagcgtttattaccggtactttgtcaggcccacggtcttacaccagaacaagttgtggccatagccagtaataatggcggaaagcaggctctggaaacggtacaacgtctgttacctgttctgtgtcaagcgcacggattaacacctgaacaagtagttgccattgcgtcaaacaatggaggcaagcaggccttggagacagtgcagagattactgccagtgttgtgtcaggctcatggccttacacccgagcaggtcgtggcaattgcatctaacattggcggtaagcaagctttagagactgttcagagactgcttcctgtcctgtgccaggcacacggacttacgcctgagcaagtggttgcaatcgcctctaatatcggtggtaagcaagcactggaaactgtccaacgcttacttccggtgctttgtcaagcacacggcttaacgccagagcaggtcgtcgccatagccagcaataatggtggtaaacaggcccttgaaacggtccaaagacttctgccggtcctttgccaagcgcatgggctgacacctgagcaggtagtcgcgattgcctcaaacaatggtgggaagcaggcattagaaacagttcaaagattattaccagtcctgtgtcaggcgcatgggttaaccccagagcaggtagttgcaatagcatcccatgatggcggaaaacaagcgttggaaacggttcagcggttattgcctgttttgtgccaggcgcatggtttgacacccgagcaagtggtagccatagcctcaaatatagggggtaaacaagctttggagacagtacaacggctgcttccagttttatgtcaggcccatggattgacgcctgaacaagttgtcgctatcgcaagtaataatggtggtaaacaagcgcttgaaaccgttcaacgccttctgcctgtgctttgtcaggcacatggattaacacccgaacaggttgtcgcgatagcttcaaacattggtggtcgtccggcactggaaagcattgttgcacagctgagccgtcctgatccggcactggcagcactgaccaatgatcatctggttgcactggcatgtctgggtggtcgccctgccctggatgcagttaaaaaaggtctgccgcatgcaccggcactgattaaacgtaccaatcgtcgtattccggaacgtaccagccatcgtgttgctagcggcagcggcggcggcagcggcggcgacgccctggacgacttcgacctggacatgctgggcagcgacgccctggacgacttcgacctggacatgctgggcagcgacgccctggacgacttcgacctggacatgctgggcagcgacgccctggacgacttcgacctggacatgctgagcggcggccccaagaagaagcggaaggtgggcagccagtacctgcccgacaccgacgaccggcaccggatcgaggagaagcggaagcggacctacgagaccttcaagagcatcatgaagaaatcccccttcagcggccccaccgacccccggccccccccccggcggatcgccgtgcccagccggagcagcgccagcgtgcccaagcccgccccccagccctaccccttcaccagcagcctgagcaccatcaactacgacgagttccccaccatggtgttccccagcggccagatcagccaggccagcgccctggcccccgcccccccccaggtgctgccccaggcccccgcccccgcccccgcccccgccatggtgagcgccctggcccaggcccccgcccccgtgcccgtgctggcccccggccccccccaggccgtggccccccccgcccccaagcccacccaggccggcgagggcaccctgagcgaggccctgctgcagctgcagttcgacgacgaggacctgggcgccctgctgggcaacagcaccgaccccgccgtgttcaccgacctggccagcgtggacaacagcgagttccagcagctgctgaaccagggcatccccgtggccccccacaccaccgagcccatgctgatggagtaccccgaggccatcacccggctggtgaccggcgcccagcggccccccgaccccgcccccgcccccctgggcgcccccggcctgcccaacggcctgctgagcggcgacgaggacttcagcagcatcgccgacatggacttcagcgccctgctgggcagcggcagcggcagccgggacagccgggagggcatgttcctgcccaagcccgaggccggcagcgccatcagcgacgtgttcgagggccgggaggtgtgccagcccaagcggctccggcccttccacccccccggcagcccctgggccaaccggcccctgcccgccagcctggcccccacccccaccggccccgtgcacgagcccgtgggcagcctgacccccgcccccgtgccccagcccctggaccccgcccccgccgtgacccccgaggccagccacctgctggaggaccccgacgaggagaccagccaggccgtgaaggccctgcgggagatggccgacaccgtgatcccccagaaggaggaggccgccatctgcggccagatggacctgagccacccccccccccggggccacctggacgagctgaccaccaccctggagagcatgaccgaggacctgaacctggacagccccctgacccccgagctgaacgagatcctggacaccttcctgaacgacgagtgcctgctgcacgccatgcacatcagcaccggcctgagcatcttcgacaccagcctgttcagcggcggcaagcggcccgccgccaccaagaaggccggccaggccaagaagaagaagggcagctacccctacgacgtgcccgactacgcctgagcggccgcttaattaagctgccttctgcggggcttgccttctggccatgcccttcttctctcccttgcacctgtacctcttggtctttgaataaagcctgagtaggaagtctagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 192 - protein, 802 aa, Artificial Sequence
  source: /note="Description of Artificial Sequence: Synthetic polypeptide"
GSHMVDLRTLGYSQQQQEKIKPKVRSTVAQHHEALVGHGFTHAHIVALSQHPAALGTVAVKYQDMIAALPEATHEAIVGVGKRGAGARALEALLTVAGELRGPPLQLDTGQLLKIAKRGGVTAVEAVHAWRNALTGAPLNLTPEQVVAIASNNGGKQALETVQRLLPVLCQAHGLTPEQVVAIASNGGGKQALETVQRLLPVLCQAHGLTPEQVVAIASNGGGKQALETVQRLLPVLCQAHGLTPEQVVAIASNGGGKQALETVQRLLPVLCQAHGLTPEQVVAIASNNGGKQALETVQRLLPVLCQAHGLTPEQVVAIASNIGGKQALETVQRLLPVLCQAHGLTPEQVVAIASNIGGKQALETVQRLLPVLCQAHGLTPEQVVAIASNIGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNIGGKQALETVQRLLPVLCQAHGLTPEQVVAIASNIGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASNNGGKQALETVQRLLPVLCQAHGLTPEQVVAIASNIGGRPALESIVAQLSRPDPALAALTNDHLVALACLGGRPALDAVKKGLPHAPALIKRTNRRIPERTSHRVAS

SEQ ID NO: 193 - protein, 1377 aa, Artificial Sequence
  source: /note="Description of Artificial Sequence: Synthetic polypeptide"
MAPKKKRKVGIHGVPAAGSSGSHMVDLRTLGYSQQQQEKIKPKVRSTVAQHHEALVGHGFTHAHIVALSQHPAALGTVAVKYQDMIAALPEATHEAIVGVGKRGAGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASNNGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASNNGGKQALETVQRLLPVLCQAHGLTPEQVVAIASNIGGKQALETVQRLLPVLCQAHGLTPEQVVAIASNGGGKQALETVQRLLPVLCQAHGLTPEQVVAIASHDGGKQALETVQRLLPVLCQAHGLTPEQVVAIASNGGGKQALETVQRLLPVLCQAHGLTPEQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASNNGGKQALETVQRLLPVLCQAHGLTPEQVVAIASNIGGRPALESIVAQLSRPDPALAALTNDHLVALACLGGRPALDAVKKGLPHAPALIKRTNRRIPERTSHRVASGSGGGSGGDALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRLRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFSGGKRPAATKKAGQAKKKKGSYPYDVPDY

SEQ ID NO: 194 - DNA, 4378 bp, Artificial Sequence
  source: /note="Description of Artificial Sequence: Synthetic polynucleotide"
aggaaataagagagaaaagaagagtaagaagaaatataagagccaccatggcccccaagaagaagcggaaggtgggcatccacggcgtgcccgccgccggcagcagcggatcccatatggttgatctgcgtaccctgggttatagccagcagcagcaagaaaaaatcaaaccgaaagttcgtagcaccgttgcacagcatcatgaagcactggttggtcatggttttacccatgcacatattgttgcactgagccagcatccggcagcactgggcaccgttgcagttaaatatcaggatatgattgcagcactgccggaagcaacccatgaagcaattgttggtgttggtaaacgcggagctggtgcacgtgccctggaagcactgctgaccgttgccggtgaactgcgtggtccgcctctgcagctggataccggtcagctgctgaaaattgcaaaacgtggtggtgttaccgcagttgaagcagttcatgcatggcgtaatgcactgaccggtgcaccgctgaatctgacaccggaacaggttgttgcaattgccagccatgatggtggcaaacaggcactggaaaccgttcagcgtctgctgccggttctgtgtcaggcacatggtctgacccctgaacaggtggtggccattgcaagccatgacggcggtaaacaagccctggaaacagtgcagcgcctgttaccggtgctgtgccaggcccatggcttaactccggaacaggtggtagcgatcgcatcaaacattggaggtaaacaggccttagaaaccgtacagcgcttactgccggtgttatgccaggcgcacggcctgacgccagaacaggtagtggcaatcgcctcaaataatggtggaaaacaggcgttagagacagtccagcgcctgctgcctgtattatgtcaagcccatggcctgaccccagagcaagttgttgcgattgcaagtcatgatgggggtaaacaggcacttgagacagttcaacgtttactgcctgtactgtgccaagctcacggtctgactccggaacaagtcgtcgcgattgcgagtaatatcggtggcaaacaagcattagaaacggtgcaacgcctgctgccagttctttgccaggctcacggtttaacccctgagcaggttgtagctattgcgagtaacaatggtggtaagcaggcgttggaaactgtgcaaagactgctgcccgtgttgtgccaagcacatggtttaaccccagaacaagtcgtagcaatcgcaagcaatataggtggcaagcaagcgcttgaaacagtacagcgtttattaccggtactttgtcaggcccacggtcttacaccagaacaagttgtggccatagccagtaatggtggcggaaagcaggctctggaaacggtacaacgtctgttacctgttctgtgtcaagcgcacggattaacacctgaacaagtagttgccattgcgtcacatgacggaggcaagcaggccttggagacagtgcagagattactgccagtgttgtgtcaggctcatggccttacacccgagcaggtcgtggcaattgcatctaatggcggcggtaagcaagctttagagactgttcagagactgcttcctgtcctgtgccaggcacacggacttacgcctgagcaagtggttgcaatcgcctctaatgggggtggtaagcaagcactggaaactgtccaacgcttacttccggtgctttgtcaagcacacggcttaacgccagagcaggtcgtcgccatagccagccatgatggtggtaaacaggcccttgaaacggtccaaagacttctgccggtcctttgccaagcgcatgggctgacacctgagcaggtagtcgcgattgcctcacatgacggtgggaagcaggcattagaaacagttcaaagattattaccagtcctgtgtcaggcgcatgggttaaccccagagcaggtagttgcaatagcatcccatgatggcggaaaacaagcgttggaaacggttcagcggttattgcctgttttgtgccaggcgcatggtttgacacccgagcaagtggtagccatagcctcaaacattgggggtaaacaagctttggagacagtacaacggctgcttccagttttatgtcaggcccatggattgacgcctgaacaagttgtcgctatcgcaagtaataatggtggtaaacaagcgcttgaaaccgttcaacgccttctgcctgtgctttgtcaggcacatggattaacacccgaacaggttgtcgcgatagcttcaaatatcggtggtcgtccggcactggaaagcattgttgcacagctgagccgtcctgatccggcactggcagcactgaccaatgatcatctggttgcactggcatgtctgggtggtcgccctgccctggatgcagttaaaaaaggtctgccgcatgcaccggcactgattaaacgtaccaatcgtcgtattccggaacgtaccagccatcgtgttgctagcggcagcggcggcggcagcggcggcgacgccctggacgacttcgacctggacatgctgggcagcgacgccctggacgacttcgacctggacatgctgggcagcgacgccctggacgacttcgacctggacatgctgggcagcgacgccctggacgacttcgacctggacatgctgagcggcggccccaagaagaagcggaaggtgggcagccagtacctgcccgacaccgacgaccggcaccggatcgaggagaagcggaagcggacctacgagaccttcaagagcatcatgaagaaatcccccttcagcggccccaccgacccccggccccccccccggcggatcgccgtgcccagccggagcagcgccagcgtgcccaagcccgccccccagccctaccccttcaccagcagcctgagcaccatcaactacgacgagttccccaccatggtgttccccagcggccagatcagccaggccagcgccctggcccccgcccccccccaggtgctgccccaggcccccgcccccgcccccgcccccgccatggtgagcgccctggcccaggcccccgcccccgtgcccgtgctggcccccggccccccccaggccgtggccccccccgcccccaagcccacccaggccggcgagggcaccctgagcgaggccctgctgcagctgcagttcgacgacgaggacctgggcgccctgctgggcaacagcaccgaccccgccgtgttcaccgacctggccagcgtggacaacagcgagttccagcagctgctgaaccagggcatccccgtggccccccacaccaccgagcccatgctgatggagtaccccgaggccatcacccggctggtgaccggcgcccagcggccccccgaccccgcccccgcccccctgggcgcccccggcctgcccaacggcctgctgagcggcgacgaggacttcagcagcatcgccgacatggacttcagcgccctgctgggcagcggcagcggcagccgggacagccgggagggcatgttcctgcccaagcccgaggccggcagcgccatcagcgacgtgttcgagggccgggaggtgtgccagcccaagcggctccggcccttccacccccccggcagcccctgggccaaccggcccctgcccgccagcctggcccccacccccaccggccccgtgcacgagcccgtgggcagcctgacccccgcccccgtgccccagcccctggaccccgcccccgccgtgacccccgaggccagccacctgctggaggaccccgacgaggagaccagccaggccgtgaaggccctgcgggagatggccgacaccgtgatcccccagaaggaggaggccgccatctgcggccagatggacctgagccacccccccccccggggccacctggacgagctgaccaccaccctggagagcatgaccgaggacctgaacctggacagccccctgacccccgagctgaacgagatcctggacaccttcctgaacgacgagtgcctgctgcacgccatgcacatcagcaccggcctgagcatcttcgacaccagcctgttcagcggcggcaagcggcccgccgccaccaagaaggccggccaggccaagaagaagaagggcagctacccctacgacgtgcccgactacgcctgagcggccgcttaattaagctgccttctgcggggcttgccttctggccatgcccttcttctctcccttgcacctgtacctcttggtctttgaataaagcctgagtaggaagtctagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 195 - protein, 802 aa, Artificial Sequence
  source: /note="Description of Artificial Sequence: Synthetic polypeptide"
GSHMVDLRTLGYSQQQQEKIKPKVRSTVAQHHEALVGHGFTHAHIVALSQHPAALGTVAVKYQDMIAALPEATHEAIVGVGKRGAGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASNNGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASNNGGKQALETVQRLLPVLCQAHGLTPEQVVAIASNIGGKQALETVQRLLPVLCQAHGLTPEQVVAIASNGGGKQALETVQRLLPVLCQAHGLTPEQVVAIASHDGGKQALETVQRLLPVLCQAHGLTPEQVVAIASNGGGKQALETVQRLLPVLCQAHGLTPEQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASNNGGKQALETVQRLLPVLCQAHGLTPEQVVAIASNIGGRPALESIVAQLSRPDPALAALTNDHLVALACLGGRPALDAVKKGLPHAPALIKRTNRRIPERTSHRVAS

SEQ ID NO: 196 - protein, 1378 aa, Artificial Sequence
  source: /note="Description of Artificial Sequence: Synthetic polypeptide"
MAPKKKRKVGIHGVPAAGSSGSHMVDLRTLGYSQQQQEKIKPKVRSTVAQHHEALVGHGFTHAHIVALSQHPAALGTVAVKYQDMIAALPEATHEAIVGVGKRGAGARALEALLTVAGELRGPPLQLDTGQLLKIAKRGGVTAVEAVHAWRNALTGAPLNLTPEQVVAIASNNGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNNGGKQALETVQRLLPVLCQAHGLTPEQVVAIASNIGGKQALETVQRLLPVLCQAHGLTPEQVVAIASNGGGKQALETVQRLLPVLCQAHGLTPEQVVAIASNGGGKQALETVQRLLPVLCQAHGLTPEQVVAIASNIGGKQALETVQRLLPVLCQAHGLTPEQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVASGSGGGSGGDALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRLRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFSGGKRPAATKKAGQAKKKKGSYPYDVPDYA

SEQ ID NO: 197 - DNA, 4378 bp, Artificial Sequence
  source: /note="Description of Artificial Sequence: Synthetic polynucleotide"
aggaaataagagagaaaagaagagtaagaagaaatataagagccaccatggcccccaagaagaagcggaaggtgggcatccacggcgtgcccgccgccggcagcagcggatcccatatggttgatctgcgtaccctgggttatagccagcagcagcaagaaaaaatcaaaccgaaagttcgtagcaccgttgcacagcatcatgaagcactggttggtcatggttttacccatgcacatattgttgcactgagccagcatccggcagcactgggcaccgttgcagttaaatatcaggatatgattgcagcactgccggaagcaacccatgaagcaattgttggtgttggtaaacgcggagctggtgcacgtgccctggaagcactgctgaccgttgccggtgaactgcgtggtccgcctctgcagctggataccggtcagctgctgaaaattgcaaaacgtggtggtgttaccgcagttgaagcagttcatgcatggcgtaatgcactgaccggtgcaccgctgaatctgacaccggaacaggttgttgcaattgccagcaataatggtggcaaacaggcactggaaaccgttcagcgtctgctgccggttctgtgtcaggcacatggtctgacccctgaacaggtggtggccattgcaagcaacaatggcggtaaacaagccctggaaacagtgcagcgcctgttaccggtgctgtgccaggcccatggcttaactccggaacaggtggtagcgatcgcatcaaataatggaggtaaacaggccttagaaaccgtacagcgcttactgccggtgttatgccaggcgcacggcctgacgccagaacaggtagtggcaatcgcctcaaacaatggtggaaaacaggcgttagagacagtccagcgcctgctgcctgtattatgtcaagcccatggcctgaccccagagcaagttgttgcgattgcaagtaataatgggggtaaacaggcacttgagacagttcaacgtttactgcctgtactgtgccaagctcacggtctgactccggaacaagtcgtcgcgattgcgagtaacattggtggcaaacaagcattagaaacggtgcaacgcctgctgccagttctttgccaggctcacggtttaacccctgagcaggttgtagctattgcgagtcatgatggtggtaagcaggcgttggaaactgtgcaaagactgctgcccgtgttgtgccaagcacatggtttaaccccagaacaagtcgtagcaatcgcaagccatgacggtggcaagcaagcgcttgaaacagtacagcgtttattaccggtactttgtcaggcccacggtcttacaccagaacaagttgtggccatagccagtaacaatggcggaaagcaggctctggaaacggtacaacgtctgttacctgttctgtgtcaagcgcacggattaacacctgaacaagtagttgccattgcgtcaaatatcggaggcaagcaggccttggagacagtgcagagattactgccagtgttgtgtcaggctcatggccttacacccgagcaggtcgtggcaattgcatctaatggtggcggtaagcaagctttagagactgttcagagactgcttcctgtcctgtgccaggcacacggacttacgcctgagcaagtggttgcaatcgcctctaatggcggtggtaagcaagcactggaaactgtccaacgcttacttccggtgctttgtcaagcacacggcttaacgccagagcaggtcgtcgccatagccagcaatataggtggtaaacaggcccttgaaacggtccaaagacttctgccggtcctttgccaagcgcatgggctgacacctgagcaggtagtcgcgattgcctcaaacattggtgggaagcaggcattagaaacagttcaaagattattaccagtcctgtgtcaggcgcatgggttaaccccagagcaggtagttgcaatagcatcccatgatggcggaaaacaagcgttggaaacggttcagcggttattgcctgttttgtgccaggcgcatggtttgacacccgagcaagtggtagccatagcctcacatgacgggggtaaacaagctttggagacagtacaacggctgcttccagttttatgtcaggcccatggattgacgcctgaacaagttgtcgctatcgcaagtaatatcggtggtaaacaagcgcttgaaaccgttcaacgccttctgcctgtgctttgtcaggcacatggattaacacccgaacaggttgtcgcgatagcttcaaatgggggtggtcgtccggcactggaaagcattgttgcacagctgagccgtcctgatccggcactggcagcactgaccaatgatcatctggttgcactggcatgtctgggtggtcgccctgccctggatgcagttaaaaaaggtctgccgcatgcaccggcactgattaaacgtaccaatcgtcgtattccggaacgtaccagccatcgtgttgctagcggcagcggcggcggcagcggcggcgacgccctggacgacttcgacctggacatgctgggcagcgacgccctggacgacttcgacctggacatgctgggcagcgacgccctggacgacttcgacctggacatgctgggcagcgacgccctggacgacttcgacctggacatgctgagcggcggccccaagaagaagcggaaggtgggcagccagtacctgcccgacaccgacgaccggcaccggatcgaggagaagcggaagcggacctacgagaccttcaagagcatcatgaagaaatcccccttcagcggccccaccgacccccggccccccccccggcggatcgccgtgcccagccggagcagcgccagcgtgcccaagcccgccccccagccctaccccttcaccagcagcctgagcaccatcaactacgacgagttccccaccatggtgttccccagcggccagatcagccaggccagcgccctggcccccgcccccccccaggtgctgccccaggcccccgcccccgcccccgcccccgccatggtgagcgccctggcccaggcccccgcccccgtgcccgtgctggcccccggccccccccaggccgtggccccccccgcccccaagcccacccaggccggcgagggcaccctgagcgaggccctgctgcagctgcagttcgacgacgaggacctgggcgccctgctgggcaacagcaccgaccccgccgtgttcaccgacctggccagcgtggacaacagcgagttccagcagctgctgaaccagggcatccccgtggccccccacaccaccgagcccatgctgatggagtaccccgaggccatcacccggctggtgaccggcgcccagcggccccccgaccccgcccccgcccccctgggcgcccccggcctgcccaacggcctgctgagcggcgacgaggacttcagcagcatcgccgacatggacttcagcgccctgctgggcagcggcagcggcagccgggacagccgggagggcatgttcctgcccaagcccgaggccggcagcgccatcagcgacgtgttcgagggccgggaggtgtgccagcccaagcggctccggcccttccacccccccggcagcccctgggccaaccggcccctgcccgccagcctggcccccacccccaccggccccgtgcacgagcccgtgggcagcctgacccccgcccccgtgccccagcccctggaccccgcccccgccgtgacccccgaggccagccacctgctggaggaccccgacgaggagaccagccaggccgtgaaggccctgcgggagatggccgacaccgtgatcccccagaaggaggaggccgccatctgcggccagatggacctgagccacccccccccccggggccacctggacgagctgaccaccaccctggagagcatgaccgaggacctgaacctggacagccccctgacccccgagctgaacgagatcctggacaccttcctgaacgacgagtgcctgctgcacgccatgcacatcagcaccggcctgagcatcttcgacaccagcctgttcagcggcggcaagcggcccgccgccaccaagaaggccggccaggccaagaagaagaagggcagctacccctacgacgtgcccgactacgcctgagcggccgcttaattaagctgccttctgcggggcttgccttctggccatgcccttcttctctcccttgcacctgtacctcttggtctttgaataaagcctgagtaggaagtctagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 198 - protein, 802 aa, Artificial Sequence
  source: /note="Description of Artificial Sequence: Synthetic polypeptide"
GSHMVDLRTLGYSQQQQEKIKPKVRSTVAQHHEALVGHGFTHAHIVALSQHPAALGTVAVKYQDMIAALPEATHEAIVGVGKRGAGARALEALLTVAGELRGPPLQLDTGQLLKIAKRGGVTAVEAVHAWRNALTGAPLNLTPEQVVAIASNNGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNNGGKQALETVQRLLPVLCQAHGLTPEQVVAIASNIGGKQALETVQRLLPVLCQAHGLTPEQVVAIASNGGGKQALETVQRLLPVLCQAHGLTPEQVVAIASNGGGKQALETVQRLLPVLCQAHGLTPEQVVAIASNIGGKQALETVQRLLPVLCQAHGLTPEQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVAS

SEQ ID NO: 199 - protein, 1377 aa, Artificial Sequence
  source: /note="Description of Artificial Sequence: Synthetic polypeptide"
MAPKKKRKVGIHGVPAAGSSGSHMVDLRTLGYSQQQQEKIKPKVRSTVAQHHEALVGHGFTHAHIVALSQHPAALGTVAVKYQDMIAALPEATHEAIVGVGKRGAGARALEALLTVAGELRGPPLQLDTGQLLKIAKRGGVTAVEAVHAWRNALTGAPLNLTPEQVVAIASNNGGKQALETVQRLLPVLCQAHGLTPEQVVAIASNNGGKQALETVQRLLPVLCQAHGLTPEQVVAIASNGGGKQALETVQRLLPVLCQAHGLTPEQVVAIASNNGGKQALETVQRLLPVLCQAHGLTPEQVVAIASNGGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASNNGGKQALETVQRLLPVLCQAHGLTPEQVVAIASNIGGKQALETVQRLLPVLCQAHGLTPEQVVAIASNIGGKQALETVQRLLPVLCQAHGLTPEQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGRPALESIVAQLSRPDPALAALTNDHLVALACLGGRPALDAVKKGLPHAPALIKRTNRRIPERTSHRVASGSGGGSGGDALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRLRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFSGGKRPAATKKAGQAKKKKGSYPYDVPDY

SEQ ID NO: 200 - DNA, 4378 bp, Artificial Sequence
  source: /note="Description of Artificial Sequence: Synthetic polynucleotide"
aggaaataagagagaaaagaagagtaagaagaaatataagagccaccatggcccccaagaagaagcggaaggtgggcatccacggcgtgcccgccgccggcagcagcggatcccatatggttgatctgcgtaccctgggttatagccagcagcagcaagaaaaaatcaaaccgaaagttcgtagcaccgttgcacagcatcatgaagcactggttggtcatggttttacccatgcacatattgttgcactgagccagcatccggcagcactgggcaccgttgcagttaaatatcaggatatgattgcagcactgccggaagcaacccatgaagcaattgttggtgttggtaaacgcggagctggtgcacgtgccctggaagcactgctgaccgttgccggtgaactgcgtggtccgcctctgcagctggataccggtcagctgctgaaaattgcaaaacgtggtggtgttaccgcagttgaagcagttcatgcatggcgtaatgcactgaccggtgcaccgctgaatctgacaccggaacaggttgttgcaattgccagcaataatggtggcaaacaggcactggaaaccgttcagcgtctgctgccggttctgtgtcaggcacatggtctgacccctgaacaggtggtggccattgcaagcaacaatggcggtaaacaagccctggaaacagtgcagcgcctgttaccggtgctgtgccaggcccatggcttaactccggaacaggtggtagcgatcgcatcaaatggtggaggtaaacaggccttagaaaccgtacagcgcttactgccggtgttatgccaggcgcacggcctgacgccagaacaggtagtggcaatcgcctcaaataatggtggaaaacaggcgttagagacagtccagcgcctgctgcctgtattatgtcaagcccatggcctgaccccagagcaagttgttgcgattgcaagtaatggcgggggtaaacaggcacttgagacagttcaacgtttactgcctgtactgtgccaagctcacggtctgactccggaacaagtcgtcgcgattgcgagtcatgatggtggcaaacaagcattagaaacggtgcaacgcctgctgccagttctttgccaggctcacggtttaacccctgagcaggttgtagctattgcgagtaacattggtggtaagcaggcgttggaaactgtgcaaagactgctgcccgtgttgtgccaagcacatggtttaaccccagaacaagtcgtagcaatcgcaagcaacaatggtggcaagcaagcgcttgaaacagtacagcgtttattaccggtactttgtcaggcccacggtcttacaccagaacaagttgtggccatagccagtcatgacggcggaaagcaggctctggaaacggtacaacgtctgttacctgttctgtgtcaagcgcacggattaacacctgaacaagtagttgccattgcgtcacatgatggaggcaagcaggccttggagacagtgcagagattactgccagtgttgtgtcaggctcatggccttacacccgagcaggtcgtggcaattgcatctaatatcggcggtaagcaagctttagagactgttcagagactgcttcctgtcctgtgccaggcacacggacttacgcctgagcaagtggttgcaatcgcctctaataatggtggtaagcaagcactggaaactgtccaacgcttacttccggtgctttgtcaagcacacggcttaacgccagagcaggtcgtcgccatagccagcaatataggtggtaaacaggcccttgaaacggtccaaagacttctgccggtcctttgccaagcgcatgggctgacacctgagcaggtagtcgcgattgcctcaaacattggtgggaagcaggcattagaaacagttcaaagattattaccagtcctgtgtcaggcgcatgggttaaccccagagcaggtagttgcaatagcatccaatatcggcggaaaacaagcgttggaaacggttcagcggttattgcctgttttgtgccaggcgcatggtttgacacccgagcaagtggtagccatagcctcacatgatgggggtaaacaagctttggagacagtacaacggctgcttccagttttatgtcaggcccatggattgacgcctgaacaagttgtcgctatcgcaagtcatgacggtggtaaacaagcgcttgaaaccgttcaacgccttctgcctgtgctttgtcaggcacatggattaacacccgaacaggttgtcgcgatagcttcaaatataggtggtcgtccggcactggaaagcattgttgcacagctgagccgtcctgatccggcactggcagcactgaccaatgatcatctggttgcactggcatgtctgggtggtcgccctgccctggatgcagttaaaaaaggtctgccgcatgcaccggcactgattaaacgtaccaatcgtcgtattccggaacgtaccagccatcgtgttgctagcggcagcggcggcggcagcggcggcgacgccctggacgacttcgacctggacatgctgggcagcgacgccctggacgacttcgacctggacatgctgggcagcgacgccctggacgacttcgacctggacatgctgggcagcgacgccctggacgacttcgacctggacatgctgagcggcggccccaagaagaagcggaaggtgggcagccagtacctgcccgacaccgacgaccggcaccggatcgaggagaagcggaagcggacctacgagaccttcaagagcatcatgaagaaatcccccttcagcggccccaccgacccccggccccccccccggcggatcgccgtgcccagccggagcagcgccagcgtgcccaagcccgccccccagccctaccccttcaccagcagcctgagcaccatcaactacgacgagttccccaccatggtgttccccagcggccagatcagccaggccagcgccctggcccccgcccccccccaggtgctgccccaggcccccgcccccgcccccgcccccgccatggtgagcgccctggcccaggcccccgcccccgtgcccgtgctggcccccggccccccccaggccgtggccccccccgcccccaagcccacccaggccggcgagggcaccctgagcgaggccctgctgcagctgcagttcgacgacgaggacctgggcgccctgctgggcaacagcaccgaccccgccgtgttcaccgacctggccagcgtggacaacagcgagttccagcagctgctgaaccagggcatccccgtggccccccacaccaccgagcccatgctgatggagtaccccgaggccatcacccggctggtgaccggcgcccagcggccccccgaccccgcccccgcccccctgggcgcccccggcctgcccaacggcctgctgagcggcgacgaggacttcagcagcatcgccgacatggacttcagcgccctgctgggcagcggcagcggcagccgggacagccgggagggcatgttcctgcccaagcccgaggccggcagcgccatcagcgacgtgttcgagggccgggaggtgtgccagcccaagcggctccggcccttccacccccccggcagcccctgggccaaccggcccctgcccgccagcctggcccccacccccaccggccccgtgcacgagcccgtgggcagcctgacccccgcccccgtgccccagcccctggaccccgcccccgccgtgacccccgaggccagccacctgctggaggaccccgacgaggagaccagccaggccgtgaaggccctgcgggagatggccgacaccgtgatcccccagaaggaggaggccgccatctgcggccagatggacctgagccacccccccccccggggccacctggacgagctgaccaccaccctggagagcatgaccgaggacctgaacctggacagccccctgacccccgagctgaacgagatcctggacaccttcctgaacgacgagtgcctgctgcacgccatgcacatcagcaccggcctgagcatcttcgacaccagcctgttcagcggcggcaagcggcccgccgccaccaagaaggccggccaggccaagaagaagaagggcagctacccctacgacgtgcccgactacgcctgagcggccgcttaattaagctgccttctgcggggcttgccttctggccatgcccttcttctctcccttgcacctgtacctcttggtctttgaataaagcctgagtaggaagtctagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 201 - protein, 802 aa, Artificial Sequence
  source: /note="Description of Artificial Sequence: Synthetic polypeptide"
GSHMVDLRTLGYSQQQQEKIKPKVRSTVAQHHEALVGHGFTHAHIVALSQHPAALGTVAVKYQDMIAALPEATHEAIVGVGKRGAGARALEALLTVAGELRGPPLQLDTGQLLKIAKRGGVTAVEAVHAWRNALTGAPLNLTPEQVVAIASNNGGKQALETVQRLLPVLCQAHGLTPEQVVAIASNNGGKQALETVQRLLPVLCQAHGLTPEQVVAIASNGGGKQALETVQRLLPVLCQAHGLTPEQVVAIASNNGGKQALETVQRLLPVLCQAHGLTPEQVVAIASNGGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASNNGGKQALETVQRLLPVLCQAHGLTPEQVVAIASNIGGKQALETVQRLLPVLCQAHGLTPEQVVAIASNIGGKQALETVQRLLPVLCQAHGLTPEQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGRPALESIVAQLSRPDPALAALTNDHLVALACLGGRPALDAVKKGLPHAPALIKRTNRRIPERTSHRVAS

SEQ ID NO: 202 - protein, 1378 aa, Artificial Sequence
  source: /note="Description of Artificial Sequence: Synthetic polypeptide"
MAPKKKRKVGIHGVPAAGSSGSHMVDLRTLGYSQQQQEKIKPKVRSTVAQHHEALVGHGFTHAHIVALSQHPAALGTVAVKYQDMIAALPEATHEAIVGVGKRGAGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASNGGGKQALETVQRLLPVLCQAHGLTPEQVVAIASNNGGKQALETVQRLLPVLCQAHGLTPEQVVAIASNIGGKQALETVQRLLPVLCQAHGLTPEQVVAIASNIGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASNGGGKQALETVQRLLPVLCQAHGLTPEQVVAIASHDGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNGGGKQALETVQRLLPVLCQAHGLTPEQVVAIASNNGGKQALETVQRLLPVLCQAHGLTPEQVVAIASNIGGKQALETVQRLLPVLCQAHGLTPEQVVAIASNNGGKQALETVQRLLPVLCQAHGLTPEQVVAIASNGGGKQALETVQRLLPVLCQAHGLTPEQVVAIASNGGGKQALETVQRLLPVLCQAHGLTPEQVVAIASNIGGRPALESIVAQLSRPDPALAALTNDHLVALACLGGRPALDAVKKGLPHAPALIKRTNRRIPERTSHRVASGSGGGSGGDALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRLRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFSGGKRPAATKKAGQAKKKKGSYPYDVPDYA

SEQ ID NO: 203 - DNA, 4378 bp, Artificial Sequence
  source: /note="Description of Artificial Sequence: Synthetic polynucleotide"
aggaaataagagagaaaagaagagtaagaagaaatataagagccaccatggcccccaagaagaagcggaaggtgggcatccacggcgtgcccgccgccggcagcagcggatcccatatggttgatctgcgtaccctgggttatagccagcagcagcaagaaaaaatcaaaccgaaagttcgtagcaccgttgcacagcatcatgaagcactggttggtcatggttttacccatgcacatattgttgcactgagccagcatccggcagcactgggcaccgttgcagttaaatatcaggatatgattgcagcactgccggaagcaacccatgaagcaattgttggtgttggtaaacgcggagctggtgcacgtgccctggaagcactgctgaccgttgccggtgaactgcgtggtccgcctctgcagctggataccggtcagctgctgaaaattgcaaaacgtggtggtgttaccgcagttgaagcagttcatgcatggcgtaatgcactgaccggtgcaccgctgaatctgacaccggaacaggttgttgcaattgccagccatgatggtggcaaacaggcactggaaaccgttcagcgtctgctgccggttctgtgtcaggcacatggtctgacccctgaacaggtggtggccattgcaagcaatggtggcggtaaacaagccctggaaacagtgcagcgcctgttaccggtgctgtgccaggcccatggcttaactccggaacaggtggtagcgatcgcatcaaataatggaggtaaacaggccttagaaaccgtacagcgcttactgccggtgttatgccaggcgcacggcctgacgccagaacaggtagtggcaatcgcctcaaacattggtggaaaacaggcgttagagacagtccagcgcctgctgcctgtattatgtcaagcccatggcctgaccccagagcaagttgttgcgattgcaagtaatatcgggggtaaacaggcacttgagacagttcaacgtttactgcctgtactgtgccaagctcacggtctgactccggaacaagtcgtcgcgattgcgagtcatgacggtggcaaacaagcattagaaacggtgcaacgcctgctgccagttctttgccaggctcacggtttaacccctgagcaggttgtagctattgcgagtaatataggtggtaagcaggcgttggaaactgtgcaaagactgctgcccgtgttgtgccaagcacatggtttaaccccagaacaagtcgtagcaatcgcaagcaatggcggtggcaagcaagcgcttgaaacagtacagcgtttattaccggtactttgtcaggcccacggtcttacaccagaacaagttgtggccatagccagtcatgatggcggaaagcaggctctggaaacggtacaacgtctgttacctgttctgtgtcaagcgcacggattaacacctgaacaagtagttgccattgcgtcaaataatggaggcaagcaggccttggagacagtgcagagattactgccagtgttgtgtcaggctcatggccttacacccgagcaggtcgtggcaattgcatctaacaatggcggtaagcaagctttagagactgttcagagactgcttcctgtcctgtgccaggcacacggacttacgcctgagcaagtggttgcaatcgcctctaatgggggtggtaagcaagcactggaaactgtccaacgcttacttccggtgctttgtcaagcacacggcttaacgccagagcaggtcgtcgccatagccagcaataatggtggtaaacaggcccttgaaacggtccaaagacttctgccggtcctttgccaagcgcatgggctgacacctgagcaggtagtcgcgattgcctcaaacattggtgggaagcaggcattagaaacagttcaaagattattaccagtcctgtgtcaggcgcatgggttaaccccagagcaggtagttgcaatagcatccaacaatggcggaaaacaagcgttggaaacggttcagcggttattgcctgttttgtgccaggcgcatggtttgacacccgagcaagtggtagccatagcctcaaacggtgggggtaaacaagctttggagacagtacaacggctgcttccagttttatgtcaggcccatggattgacgcctgaacaagttgtcgctatcgcaagtaatggtggtggtaaacaagcgcttgaaaccgttcaacgccttctgcctgtgctttgtcaggcacatggattaacacccgaacaggttgtcgcgatagcttcaaatatcggtggtcgtccggcactggaaagcattgttgcacagctgagccgtcctgatccggcactggcagcactgaccaatgatcatctggttgcactggcatgtctgggtggtcgccctgccctggatgcagttaaaaaaggtctgccgcatgcaccggcactgattaaacgtaccaatcgtcgtattccggaacgtaccagccatcgtgttgctagcggcagcggcggcggcagcggcggcgacgccctggacgacttcgacctggacatgctgggcagcgacgccctggacgacttcgacctggacatgctgggcagcgacgccctggacgacttcgacctggacatgctgggcagcgacgccctggacgacttcgacctggacatgctgagcggcggccccaagaagaagcggaaggtgggcagccagtacctgcccgacaccgacgaccggcaccggatcgaggagaagcggaagcggacctacgagaccttcaagagcatcatgaagaaatcccccttcagcggccccaccgacccccggccccccccccggcggatcgccgtgcccagccggagcagcgccagcgtgcccaagcccgccccccagccctaccccttcaccagcagcctgagcaccatcaactacgacgagttccccaccatggtgttccccagcggccagatcagccaggccagcgccctggcccccgcccccccccaggtgctgccccaggcccccgcccccgcccccgcccccgccatggtgagcgccctggcccaggcccccgcccccgtgcccgtgctggcccccggccccccccaggccgtggccccccccgcccccaagcccacccaggccggcgagggcaccctgagcgaggccctgctgcagctgcagttcgacgacgaggacctgggcgccctgctgggcaacagcaccgaccccgccgtgttcaccgacctggccagcgtggacaacagcgagttccagcagctgctgaaccagggcatccccgtggccccccacaccaccgagcccatgctgatggagtaccccgaggccatcacccggctggtgaccggcgcccagcggccccccgaccccgcccccgcccccctgggcgcccccggcctgcccaacggcctgctgagcggcgacgaggacttcagcagcatcgccgacatggacttcagcgccctgctgggcagcggcagcggcagccgggacagccgggagggcatgttcctgcccaagcccgaggccggcagcgccatcagcgacgtgttcgagggccgggaggtgtgccagcccaagcggctccggcccttccacccccccggcagcccctgggccaaccggcccctgcccgccagcctggcccccacccccaccggccccgtgcacgagcccgtgggcagcctgacccccgcccccgtgccccagcccctggaccccgcccccgccgtgacccccgaggccagccacctgctggaggaccccgacgaggagaccagccaggccgtgaaggccctgcgggagatggccgacaccgtgatcccccagaaggaggaggccgccatctgcggccagatggacctgagccacccccccccccggggccacctggacgagctgaccaccaccctggagagcatgaccgaggacctgaacctggacagccccctgacccccgagctgaacgagatcctggacaccttcctgaacgacgagtgcctgctgcacgccatgcacatcagcaccggcctgagcatcttcgacaccagcctgttcagcggcggcaagcggcccgccgccaccaagaaggccggccaggccaagaagaagaagggcagctacccctacgacgtgcccgactacgcctgagcggccgcttaattaagctgccttctgcggggcttgccttctggccatgcccttcttctctcccttgcacctgtacctcttggtctttgaataaagcctgagtaggaagtctagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 204 - protein, 802 aa, Artificial Sequence
  source: /note="Description of Artificial Sequence: Synthetic polypeptide"
GSHMVDLRTLGYSQQQQEKIKPKVRSTVAQHHEALVGHGFTHAHIVALSQHPAALGTVAVKYQDMIAALPEATHEAIVGVGKRGAGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASNGGGKQALETVQRLLPVLCQAHGLTPEQVVAIASNNGGKQALETVQRLLPVLCQAHGLTPEQVVAIASNIGGKQALETVQRLLPVLCQAHGLTPEQVVAIASNIGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASNGGGKQALETVQRLLPVLCQAHGLTPEQVVAIASHDGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNGGGKQALETVQRLLPVLCQAHGLTPEQVVAIASNNGGKQALETVQRLLPVLCQAHGLTPEQVVAIASNIGGKQALETVQRLLPVLCQAHGLTPEQVVAIASNNGGKQALETVQRLLPVLCQAHGLTPEQVVAIASNGGGKQALETVQRLLPVLCQAHGLTPEQVVAIASNGGGKQALETVQRLLPVLCQAHGLTPEQVVAIASNIGGRPALESIVAQLSRPDPALAALTNDHLVALACLGGRPALDAVKKGLPHAPALIKRTNRRIPERTSHRVAS

SEQ ID NO: 205 - protein, 1378 aa, Artificial Sequence
  source: /note="Description of Artificial Sequence: Synthetic polypeptide"
MAPKKKRKVGIHGVPAAGSSGSHMVDLRTLGYSQQQQEKIKPKVRSTVAQHHEALVGHGFTHAHIVALSQHPAALGTVAVKYQDMIAALPEATHEAIVGVGKRGAGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASNGGGKQALETVQRLLPVLCQAHGLTPEQVVAIASNGGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNGGGKQALETVQRLLPVLCQAHGLTPEQVVAIASNNGGKQALETVQRLLPVLCQAHGLTPEQVVAIASNIGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASNIGGKQALETVQRLLPVLCQAHGLTPEQVVAIASNGGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVASGSGGGSGGDALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRLRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFSGGKRPAATKKAGQAKKKKGSYPYDVPDYA

SEQ ID NO: 206 - DNA, 4378 bp, Artificial Sequence
  source: /note="Description of Artificial Sequence: Synthetic polynucleotide"
aggaaataagagagaaaagaagagtaagaagaaatataagagccaccatggcccccaagaagaagcggaaggtgggcatccacggcgtgcccgccgccggcagcagcggatcccatatggttgatctgcgtaccctgggttatagccagcagcagcaagaaaaaatcaaaccgaaagttcgtagcaccgttgcacagcatcatgaagcactggttggtcatggttttacccatgcacatattgttgcactgagccagcatccggcagcactgggcaccgttgcagttaaatatcaggatatgattgcagcactgccggaagcaacccatgaagcaattgttggtgttggtaaacgcggagctggtgcacgtgccctggaagcactgctgaccgttgccggtgaactgcgtggtccgcctctgcagctggataccggtcagctgctgaaaattgcaaaacgtggtggtgttaccgcagttgaagcagttcatgcatggcgtaatgcactgaccggtgcaccgctgaatctgacaccggaacaggttgttgcaattgccagccatgatggtggcaaacaggcactggaaaccgttcagcgtctgctgccggttctgtgtcaggcacatggtctgacccctgaacaggtggtggccattgcaagcaatggtggcggtaaacaagccctggaaacagtgcagcgcctgttaccggtgctgtgccaggcccatggcttaactccggaacaggtggtagcgatcgcatcaaatggcggaggtaaacaggccttagaaaccgtacagcgcttactgccggtgttatgccaggcgcacggcctgacgccagaacaggtagtggcaatcgcctcaaataatggtggaaaacaggcgttagagacagtccagcgcctgctgcctgtattatgtcaagcccatggcctgaccccagagcaagttgttgcgattgcaagtaacaatgggggtaaacaggcacttgagacagttcaacgtttactgcctgtactgtgccaagctcacggtctgactccggaacaagtcgtcgcgattgcgagtaataatggtggcaaacaagcattagaaacggtgcaacgcctgctgccagttctttgccaggctcacggtttaacccctgagcaggttgtagctattgcgagtaacaatggtggtaagcaggcgttggaaactgtgcaaagactgctgcccgtgttgtgccaagcacatggtttaaccccagaacaagtcgtagcaatcgcaagcaatgggggtggcaagcaagcgcttgaaacagtacagcgtttattaccggtactttgtcaggcccacggtcttacaccagaacaagttgtggccatagccagtaataatggcggaaagcaggctctggaaacggtacaacgtctgttacctgttctgtgtcaagcgcacggattaacacctgaacaagtagttgccattgcgtcaaacattggaggcaagcaggccttggagacagtgcagagattactgccagtgttgtgtcaggctcatggccttacacccgagcaggtcgtggcaattgcatctcatgacggcggtaagcaagctttagagactgttcagagactgcttcctgtcctgtgccaggcacacggacttacgcctgagcaagtggttgcaatcgcctctaatatcggtggtaagcaagcactggaaactgtccaacgcttacttccggtgctttgtcaagcacacggcttaacgccagagcaggtcgtcgccatagccagcaatataggtggtaaacaggcccttgaaacggtccaaagacttctgccggtcctttgccaagcgcatgggctgacacctgagcaggtagtcgcgattgcctcaaacggtggtgggaagcaggcattagaaacagttcaaagattattaccagtcctgtgtcaggcgcatgggttaaccccagagcaggtagttgcaatagcatccaacaatggcggaaaacaagcgttggaaacggttcagcggttattgcctgttttgtgccaggcgcatggtttgacacccgagcaagtggtagccatagcctcaaataatgggggtaaacaagctttggagacagtacaacggctgcttccagttttatgtcaggcccatggattgacgcctgaacaagttgtcgctatcgcaagtcatgatggtggtaaacaagcgcttgaaaccgttcaacgccttctgcctgtgctttgtcaggcacatggattaacacccgaacaggttgtcgcgatagcttcaaatggtggtggtcgtccggcactggaaagcattgttgcacagctgagccgtcctgatccggcactggcagcactgaccaatgatcatctggttgcactggcatgtctgggtggtcgccctgccctggatgcagttaaaaaaggtctgccgcatgcaccggcactgattaaacgtaccaatcgtcgtattccggaacgtaccagccatcgtgttgctagcggcagcggcggcggcagcggcggcgacgccctggacgacttcgacctggacatgctgggcagcgacgccctggacgacttcgacctggacatgctgggcagcgacgccctggacgacttcgacctggacatgctgggcagcgacgccctggacgacttcgacctggacatgctgagcggcggccccaagaagaagcggaaggtgggcagccagtacctgcccgacaccgacgaccggcaccggatcgaggagaagcggaagcggacctacgagaccttcaagagcatcatgaagaaatcccccttcagcggccccaccgacccccggccccccccccggcggatcgccgtgcccagccggagcagcgccagcgtgcccaagcccgccccccagccctaccccttcaccagcagcctgagcaccatcaactacgacgagttccccaccatggtgttccccagcggccagatcagccaggccagcgccctggcccccgcccccccccaggtgctgccccaggcccccgcccccgcccccgcccccgccatggtgagcgccctggcccaggcccccgcccccgtgcccgtgctggcccccggccccccccaggccgtggccccccccgcccccaagcccacccaggccggcgagggcaccctgagcgaggccctgctgcagctgcagttcgacgacgaggacctgggcgccctgctgggcaacagcaccgaccccgccgtgttcaccgacctggccagcgtggacaacagcgagttccagcagctgctgaaccagggcatccccgtggccccccacaccaccgagcccatgctgatggagtaccccgaggccatcacccggctggtgaccggcgcccagcggccccccgaccccgcccccgcccccctgggcgcccccggcctgcccaacggcctgctgagcggcgacgaggacttcagcagcatcgccgacatggacttcagcgccctgctgggcagcggcagcggcagccgggacagccgggagggcatgttcctgcccaagcccgaggccggcagcgccatcagcgacgtgttcgagggccgggaggtgtgccagcccaagcggctccggcccttccacccccccggcagcccctgggccaaccggcccctgcccgccagcctggcccccacccccaccggccccgtgcacgagcccgtgggcagcctgacccccgcccccgtgccccagcccctggaccccgcccccgccgtgacccccgaggccagccacctgctggaggaccccgacgaggagaccagccaggccgtgaaggccctgcgggagatggccgacaccgtgatcccccagaaggaggaggccgccatctgcggccagatggacctgagccacccccccccccggggccacctggacgagctgaccaccaccctggagagcatgaccgaggacctgaacctggacagccccctgacccccgagctgaacgagatcctggacaccttcctgaacgacgagtgcctgctgcacgccatgcacatcagcaccggcctgagcatcttcgacaccagcctgttcagcggcggcaagcggcccgccgccaccaagaaggccggccaggccaagaagaagaagggcagctacccctacgacgtgcccgactacgcctgagcggccgcttaattaagctgccttctgcggggcttgccttctggccatgcccttcttctctcccttgcacctgtacctcttggtctttgaataaagcctgagtaggaagtctagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 207 - protein, 802 aa, Artificial Sequence
  source: /note="Description of Artificial Sequence: Synthetic polypeptide"
GSHMVDLRTLGYSQQQQEKIKPKVRSTVAQHHEALVGHGFTHAHIVALSQHPAALGTVAVKYQDMIAALPEATHEAIVGVGKRGAGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASNGGGKQALETVQRLLPVLCQAHGLTPEQVVAIASNGGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNGGGKQALETVQRLLPVLCQAHGLTPEQVVAIASNNGGKQALETVQRLLPVLCQAHGLTPEQVVAIASNIGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASNIGGKQALETVQRLLPVLCQAHGLTPEQVVAIASNGGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVAS

SEQ ID NO: 208 - protein, 1378 aa, Artificial Sequence
  source: /note="Description of Artificial Sequence: Synthetic polypeptide"
MAPKKKRKVGIHGVPAAGSSGSHMVDLRTLGYSQQQQEKIKPKVRSTVAQHHEALVGHGFTHAHIVALSQHPAALGTVAVKYQDMIAALPEATHEAIVGVGKRGAGARALEALLTVAGELRGPPLQLDTGQLLKIAKRGGVTAVEAVHAWRNALTGAPLNLTPEQVVAIASNNGGKQALETVQRLLPVLCQAHGLTPEQVVAIASNIGGKQALETVQRLLPVLCQAHGLTPEQVVAIASNIGGKQALETVQRLLPVLCQAHGLTPEQVVAIASNGGGKQALETVQRLLPVLCQAHGLTPEQVVAIASNGGGKQALETVQRLLPVLCQAHGLTPEQVVAIASNIGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNIGGKQALETVQRLLPVLCQAHGLTPEQVVAIASNGGGKQALETVQRLLPVLCQAHGLTPEQVVAIASHDGGKQALETVQRLLPVLCQAHGLTPEQVVAIASNGGGKQALETVQRLLPVLCQAHGLTPEQVVAIASHDGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNIGGRPALESIVAQLSRPDPALAALTNDHLVALACLGGRPALDAVKKGLPHAPALIKRTNRRIPERTSHRVASGSGGGSGGDALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRLRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFSGGKRPAATKKAGQAKKKKGSYPYDVPDYA

SEQ ID NO: 209 - DNA, 4378 bp, Artificial Sequence
  source: /note="Description of Artificial Sequence: Synthetic polynucleotide"
aggaaataagagagaaaagaagagtaagaagaaatataagagccaccatggcccccaagaagaagcggaaggtgggcatccacggcgtgcccgccgccggcagcagcggatcccatatggttgatctgcgtaccctgggttatagccagcagcagcaagaaaaaatcaaaccgaaagttcgtagcaccgttgcacagcatcatgaagcactggttggtcatggttttacccatgcacatattgttgcactgagccagcatccggcagcactgggcaccgttgcagttaaatatcaggatatgattgcagcactgccggaagcaacccatgaagcaattgttggtgttggtaaacgcggagctggtgcacgtgccctggaagcactgctgaccgttgccggtgaactgcgtggtccgcctctgcagctggataccggtcagctgctgaaaattgcaaaacgtggtggtgttaccgcagttgaagcagttcatgcatggcgtaatgcactgaccggtgcaccgctgaatctgacaccggaacaggttgttgcaattgccagcaataatggtggcaaacaggcactggaaaccgttcagcgtctgctgccggttctgtgtcaggcacatggtctgacccctgaacaggtggtggccattgcaagcaacattggcggtaaacaagccctggaaacagtgcagcgcctgttaccggtgctgtgccaggcccatggcttaactccggaacaggtggtagcgatcgcatcaaatatcggaggtaaacaggccttagaaaccgtacagcgcttactgccggtgttatgccaggcgcacggcctgacgccagaacaggtagtggcaatcgcctcaaatggtggtggaaaacaggcgttagagacagtccagcgcctgctgcctgtattatgtcaagcccatggcctgaccccagagcaagttgttgcgattgcaagtaatggcgggggtaaacaggcacttgagacagttcaacgtttactgcctgtactgtgccaagctcacggtctgactccggaacaagtcgtcgcgattgcgagtaatataggtggcaaacaagcattagaaacggtgcaacgcctgctgccagttctttgccaggctcacggtttaacccctgagcaggttgtagctattgcgagtaacaatggtggtaagcaggcgttggaaactgtgcaaagactgctgcccgtgttgtgccaagcacatggtttaaccccagaacaagtcgtagcaatcgcaagcaataatggtggcaagcaagcgcttgaaacagtacagcgtttattaccggtactttgtcaggcccacggtcttacaccagaacaagttgtggccatagccagtaacaatggcggaaagcaggctctggaaacggtacaacgtctgttacctgttctgtgtcaagcgcacggattaacacctgaacaagtagttgccattgcgtcaaataatggaggcaagcaggccttggagacagtgcagagattactgccagtgttgtgtcaggctcatggccttacacccgagcaggtcgtggcaattgcatctaacattggcggtaagcaagctttagagactgttcagagactgcttcctgtcctgtgccaggcacacggacttacgcctgagcaagtggttgcaatcgcctctaatgggggtggtaagcaagcactggaaactgtccaacgcttacttccggtgctttgtcaagcacacggcttaacgccagagcaggtcgtcgccatagccagccatgatggtggtaaacaggcccttgaaacggtccaaagacttctgccggtcctttgccaagcgcatgggctgacacctgagcaggtagtcgcgattgcctcaaacggtggtgggaagcaggcattagaaacagttcaaagattattaccagtcctgtgtcaggcgcatgggttaaccccagagcaggtagttgcaatagcatcccatgacggcggaaaacaagcgttggaaacggttcagcggttattgcctgttttgtgccaggcgcatggtttgacacccgagcaagtggtagccatagcctcaaacaatgggggtaaacaagctttggagacagtacaacggctgcttccagttttatgtcaggcccatggattgacgcctgaacaagttgtcgctatcgcaagtaataatggtggtaaacaagcgcttgaaaccgttcaacgccttctgcctgtgctttgtcaggcacatggattaacacccgaacaggttgtcgcgatagcttcaaatatcggtggtcgtccggcactggaaagcattgttgcacagctgagccgtcctgatccggcactggcagcactgaccaatgatcatctggttgcactggcatgtctgggtggtcgccctgccctggatgcagttaaaaaaggtctgccgcatgcaccggcactgattaaacgtaccaatcgtcgtattccggaacgtaccagccatcgtgttgctagcggcagcggcggcggcagcggcggcgacgccctggacgacttcgacctggacatgctgggcagcgacgccctggacgacttcgacctggacatgctgggcagcgacgccctggacgacttcgacctggacatgctgggcagcgacgccctggacgacttcgacctggacatgctgagcggcggccccaagaagaagcggaaggtgggcagccagtacctgcccgacaccgacgaccggcaccggatcgaggagaagcggaagcggacctacgagaccttcaagagcatcatgaagaaatcccccttcagcggccccaccgacccccggccccccccccggcggatcgccgtgcccagccggagcagcgccagcgtgcccaagcccgccccccagccctaccccttcaccagcagcctgagcaccatcaactacgacgagttccccaccatggtgttccccagcggccagatcagccaggccagcgccctggcccccgcccccccccaggtgctgccccaggcccccgcccccgcccccgcccccgccatggtgagcgccctggcccaggcccccgcccccgtgcccgtgctggcccccggccccccccaggccgtggccccccccgcccccaagcccacccaggccggcgagggcaccctgagcgaggccctgctgcagctgcagttcgacgacgaggacctgggcgccctgctgggcaacagcaccgaccccgccgtgttcaccgacctggccagcgtggacaacagcgagttccagcagctgctgaaccagggcatccccgtggccccccacaccaccgagcccatgctgatggagtaccccgaggccatcacccggctggtgaccggcgcccagcggccccccgaccccgcccccgcccccctgggcgcccccggcctgcccaacggcctgctgagcggcgacgaggacttcagcagcatcgccgacatggacttcagcgccctgctgggcagcggcagcggcagccgggacagccgggagggcatgttcctgcccaagcccgaggccggcagcgccatcagcgacgtgttcgagggccgggaggtgtgccagcccaagcggctccggcccttccacccccccggcagcccctgggccaaccggcccctgcccgccagcctggcccccacccccaccggccccgtgcacgagcccgtgggcagcctgacccccgcccccgtgccccagcccctggaccccgcccccgccgtgacccccgaggccagccacctgctggaggaccccgacgaggagaccagccaggccgtgaaggccctgcgggagatggccgacaccgtgatcccccagaaggaggaggccgccatctgcggccagatggacctgagccacccccccccccggggccacctggacgagctgaccaccaccctggagagcatgaccgaggacctgaacctggacagccccctgacccccgagctgaacgagatcctggacaccttcctgaacgacgagtgcctgctgcacgccatgcacatcagcaccggcctgagcatcttcgacaccagcctgttcagcggcggcaagcggcccgccgccaccaagaaggccggccaggccaagaagaagaagggcagctacccctacgacgtgcccgactacgcctgagcggccgcttaattaagctgccttctgcggggcttgccttctggccatgcccttcttctctcccttgcacctgtacctcttggtctttgaataaagcctgagtaggaagtctagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 210 - protein, 802 aa, Artificial Sequence
  source: /note="Description of Artificial Sequence: Synthetic polypeptide"
GSHMVDLRTLGYSQQQQEKIKPKVRSTVAQHHEALVGHGFTHAHIVALSQHPAALGTVAVKYQDMIAALPEATHEAIVGVGKRGAGARALEALLTVAGELRGPPLQLDTGQLLKIAKRGGVTAVEAVHAWRNALTGAPLNLTPEQVVAIASNNGGKQALETVQRLLPVLCQAHGLTPEQVVAIASNIGGKQALETVQRLLPVLCQAHGLTPEQVVAIASNIGGKQALETVQRLLPVLCQAHGLTPEQVVAIASNGGGKQALETVQRLLPVLCQAHGLTPEQVVAIASNGGGKQALETVQRLLPVLCQAHGLTPEQVVAIASNIGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNIGGKQALETVQRLLPVLCQAHGLTPEQVVAIASNGGGKQALETVQRLLPVLCQAHGLTPEQVVAIASHDGGKQALETVQRLLPVLCQAHGLTPEQVVAIASNGGGKQALETVQRLLPVLCQAHGLTPEQVVAIASHDGGKQALETVQRLLPVLCQAHGLTPEQVVAIASNNGGKQALETVQRLLPVLCQAHGLTPEQVVAIASNNGGKQALETVQRLLPVLCQAHGLTPEQVVAIASNIGGRPALESIVAQLSRPDPALAALTNDHLVALACLGGRPALDAVKKGLPHAPALIKRTNRRIPERTSHRVAS

SEQ ID NO: 211 - RNA, 627 nt, Artificial Sequence
  source: /note="Description of Artificial Sequence: Synthetic polynucleotide"
cuggagccgggugagaagccauacaagugcccagaaugcggcaagagcuuuagccgcagcgauaaucugguucgucaucagcgcacgcauacgggugagaaaccguacaaauguccagaaugcggcaaaagcuuuagucgcagcgaucaucugacgaaucaccagcgcacccauaccggcgaaaaaccguacaagugcccggagugcgguaaaagcuucagcgacccgggucaucuggugcgccaccaacgcacgcacaccggugagaaaccauauaaauguccagagugcggcaagaguuuuagccagcgugcccaucuggaacgucaucagcguacccacacgggugaaaaaccauauaagugcccggagugcgguaagaguuuuaguagccgccguacgugccgugcgcaccaacgcacccacaccggugaaaagccauacaaguguccggaaugcggcaagagcuucagccgcagcgacaaacucaccgaacaucaacguacccauacgggcgagaagccguacaaaugcccagaauguggcaaaagcuucagucgcaacgauacgcugaccgagcaucagcguacgcacaccggcgaaaagccaaccggcaagaaaaccagc

SEQ ID NO: 212 - RNA, 627 nt, Artificial Sequence
  source: /note="Description of Artificial Sequence: Synthetic polynucleotide"
cuggaaccgggcgagaaaccguacaagugcccagaaugcgguaaaagcuucagccagagcaguaaucugguucgucaccagcgcacccacacgggugaaaagccauacaaauguccagagugugguaagaguuucaguagcaaaaagcaucuggcggaacaccaacguacgcauacgggugaaaagccguacaaguguccggaauguggcaagagcuuuagcagcaagaaggcgcugaccgaacaucagcguacccauaccggugaaaaaccauacaagugcccggagugcggcaaaaguuucagcgauugucgcgaucuggcccgucaucaacgcacccacaccggcgagaaaccauauaaguguccggagugcgguaaaagcuuuagcgauccgggccaucugguucgccaccaacgcacgcacaccggcgagaaaccguauaagugcccagagugcgguaagaguuuuagccguaacgaugcgcugacggagcaucagcgcacgcacacgggcgagaaaccauauaaaugcccggaaugugguaagagcuucagugacaaaaaggaucugacccgccaucaacguacgcauacgggcgagaagccaaccggcaagaaaaccagc

SEQ ID NO: 213 - RNA, 627 nt, Artificial Sequence
  source: /note="Description of Artificial Sequence: Synthetic polynucleotide"
cucgaaccgggcgagaaaccauauaaguguccggaaugugguaaaaguuuuagccgcagcgauaaucucgugcgucaccagcguacgcauaccggugagaagccauacaaguguccggaguguggcaaaagcuucagucagcuggcgcaucugcgcgcgcaucagcgcacccacaccggugagaaaccguacaaguguccagaaugcggcaaaagcuuuagcgauccgggucaucuggugcgucaucaacguacgcacacgggcgaaaaaccguacaaauguccggagugcggcaagagcuucagccagagcagcaaucugguucgccaccagcguacgcacaccggugaaaagccauacaagugcccggagugcggcaagaguuucagucgcaaggacaaucugaagaaccaucaacgcacccauacgggcgagaagccguacaaauguccggaaugcgguaaaaguuuuagccaagccggucaucuggccagccaucagcguacccauacgggugagaaaccguauaaauguccagaaugugguaagaguuucagcaccagcgguagucugguucgucaucaacgcacgcauacgggugaaaaaccaaccggcaagaaaaccagc

SEQ ID NO: 214 - RNA, 627 nt, Artificial Sequence
  source: /note="Description of Artificial Sequence: Synthetic polynucleotide"
cucgaaccgggcgaaaagccguauaagugcccggaaugcggcaagaguuuuagccagcgcgcccaucuggaacgucaccagcguacccauaccggugaaaagccauauaaaugcccagaaugugguaaaagcuuuagucagcuggcccaucugcgcgcccaccaacguacgcacacgggcgagaagccguacaaaugcccagaaugcgguaaaagcuucagcagcaaaaagcaucuggcggaacaucaacguacccacaccggcgagaaaccauacaagugcccggaaugcgguaaaagcuucagcaccaccggugcgcugacggagcaucagcgcacccacacgggcgaaaaaccguauaaguguccggaguguggcaaaaguuuuaguaccagcggcaaucuggugcgccaucaacguacgcauaccggcgagaagccauauaaauguccagaguguggcaagagcuuuagccaaagcggugaucugcgucgccaccaacgcacgcacaccggcgaaaaaccauacaaauguccggaaugcgguaagaguuucagcacgagccauagucugaccgaacaucaacguacccauacgggugagaaaccaaccggcaagaaaaccagc

SEQ ID NO: 215 - RNA, 627 nt, Artificial Sequence
  source: /note="Description of Artificial Sequence: Synthetic polynucleotide"
cucgaaccgggcgagaaaccauauaaguguccagagugugguaagagcuuuagcaccaguggcaaucugaccgagcaucaacgcacgcauacgggugagaaaccguacaagugcccggaaugcggcaaaaguuucagcgauagcggcaaucugcgugugcaccagcguacgcauacgggcgaaaagccguauaagugcccagaaugcgguaagaguuuuagccacaaaaacgcgcugcagaaccaccagcgcacccacacgggugagaagccauacaaauguccggaaugcggcaaaagcuucagccgcaacgauacgcugacggaacaccaacguacgcauaccggcgaaaagccauacaagugcccggagugcgguaaaagcuuuagccagcgcgcgcaucucgaacgucaucaacguacccauaccggugaaaaaccauauaaaugcccggaaugugguaaaaguuuuagccgcagcgacaaacuggugcgucaucaacgcacccauaccggugaaaagccauauaagugcccggagugugguaaaagcuucagcgauccgggucaucugguucgccaucaacguacgcacaccggcgagaagccaaccggcaagaaaaccagc

SEQ ID NO: 216 - RNA, 627 nt, Artificial Sequence
  source: /note="Description of Artificial Sequence: Synthetic polynucleotide"
cucgaaccgggcgaaaaaccguauaaguguccggagugcggcaagagcuucagcacgagccauagucugaccgaacaccagcgcacccacacgggcgaaaagccguacaaauguccagagugugguaagaguuucagccagcgugccaaucugcgcgcccaccaacguacccacaccggugagaagccguauaagugcccagagugugguaaaagcuucagccgcgccgauaaucugacggagcaccaacgcacccacaccggcgaaaagccauacaagugcccggaguguggcaagagcuuuagcgaacgcagccaucugcgcgaacaccaacguacgcacacgggugagaaaccauacaaauguccagaaugugguaaaaguuuuagcgauccgggcgcgcugguucgccaccagcgcacgcacaccggugaaaagccguauaaauguccagaaugcggcaaaagcuucaguaccagcggucaucugguucgucaucagcguacccauaccggcgagaagccauauaagugcccggaguguggcaaaaguuucagccgcaaugauacgcugaccgagcaucagcguacgcauaccggugaaaaaccaaccggcaagaaaaccagc

SEQ ID NO: 217 - RNA, 627 nt, Artificial Sequence
  source: /note="Description of Artificial Sequence: Synthetic polynucleotide"
cuggaaccgggcgagaagccauacaagugcccagagugcggcaaaagcuucagccgcagcgaccaucugaccaaucaccaacgcacccauaccggugagaagccguacaaaugcccagagugcgguaagagcuuuaguaccaguggcagucugguucgucaucagcgcacgcacacgggcgaaaaaccauacaaaugcccggagugcggcaaaagcuuuagccaagccggucaucuggcgagccaucaacguacgcacaccggcgagaagccguauaaauguccggagugcgguaagagcuuuagccguagcgauaaacugaccgaacaccaacguacgcauacgggcgagaaaccauauaaauguccagaguguggcaagaguuucagcaccagcggcaaucugaccgagcaucaacguacccauaccggugaaaagccauauaaauguccagaaugcgguaagaguuuuagucagagcaguaaucuggugcgccaucagcguacccacacgggugagaaaccauauaaguguccggaaugcggcaagaguuuuagcacccaucuggaucugauccgucaucagcgcacccacaccggugaaaaaccaaccggcaagaaaaccagu

SEQ ID NO: 218 - RNA, 627 nt, Artificial Sequence
  source: /note="Description of Artificial Sequence: Synthetic polynucleotide"
cuggaaccgggcgaaaagccguacaagugcccggaauguggcaaaaguuuuagucgcagcgaucaucugaccacccaucagcguacccauaccggugagaagccauacaaaugcccagaaugugguaagagcuuuagcaccagcggcgagcugguucgucaccagcguacccacaccggcgagaagccguauaaguguccagaaugcgguaaaagcuuuagccgccgcgacgagcugaaugugcaucaacgcacccacacgggcgagaagccauauaagugcccggagugugguaagaguuucaguagcccagcggaucugacccgucaucaacguacgcacacgggcgagaaaccauacaaguguccggagugcggcaaaaguuuuagccgcagugaugaacuggugcgccaccagcgcacccauaccggcgaaaaaccguauaagugcccagagugcgguaagagcuucagccgcagcgacaaacuggugcgucaccagcgcacgcauacgggugagaaaccguacaagugcccggagugcggcaaaagcuucagcaccaccggcgcgcugaccgaacaucaacguacccauacgggugagaaaccaacgggcaaaaagaccagc

SEQ ID NO: 219 - RNA, 660 nt, Artificial Sequence
  source: /note="Description of Artificial Sequence: Synthetic polynucleotide"
cucgaaccgggcgaaaagccauacaaauguccggaguguggcaagaguuucagccaaagcggcaaccucaccgagcaccagcgcacgcacaccggcgagaagccauauaaauguccagaaugcggcaagagcuucagccauaagaaugcgcugcagaaccaucagcgcacccacaccggugagaagccauacaagugcccagagugcggcaaaaguuucagccagaauagcacccucacggagcaucaacgcacgcauacgggugaaaagccguacaaaugcccagaauguggcaagagcuuuagcagcaagaaacaucuggcggagcaucagcguacccacacgggcgaaaagccauacaaauguccggaaugcggcaaaagcuucagcacgaguggcaaucuggugcgccaucaacguacgcacacgggugagaaaccguauaaaugcccagagugugguaaaagcuucagucagagcggccaucugaccgaacaccagcgcacccauacgccaaacccgcaucgccgcaccgauccgagccacaagccguuccaguacaaguguccagagugcgguaaaaguuuuagcgacaagaaggaucugacccgucaccaacguacccauaccggugaaaaaccaacgggcaagaaaaccagc

SEQ ID NO: 220 - RNA, 627 nt, Artificial Sequence
  source: /note="Description of Artificial Sequence: Synthetic polynucleotide"
cuggagcccggcgagaagcccuacaaaugucccgaguguggcaaguccuucucccagaauagcacacugacagaacaccagaggacacacaccggcgagaaaccuuauaagugccccgaaugcggcaaaagcuuuuccgagaggagccaccugagggaacaccagagaacacacaccggagaaaaaccuuacaaaugccccgagugcggaaaguccuucagcagcaagaagcaccuggcugaacaccagagaacccacaccggcgagaagccuuacaagugccccgaauguggcaaaagcuucucuagaaacgacacacucaccgagcaccagagaacccacaccggcgaaaagccuuauaagugucccgaguguggcaagagcuucagcgauuguagagaucuggccagacaccaaaggacccacaccggagaaaaaccuuacaagugccccgaguguggaaagagcuuuagccaaagcggcgaucugaggagacaccagagaacacacaccggcgaaaaacccuauaagugucccgaaugcggaaaauccuucagcaccaaaaacucucugaccgagcaccaaagaacccacaccggcgaaaagccuaccggcaaaaagacaagc

SEQ ID NO: 221 - RNA, 627 nt, Artificial Sequence
  source: /note="Description of Artificial Sequence: Synthetic polynucleotide"
cuggagcccggcgagaaacccuacaagugucccgaguguggcaagagcuuuuccgagagaagccaccugagggaacaccagagaacccacaccggcgagaagccuuacaaaugccccgaauguggaaagagcuuuucuagagccgacaaucugaccgaacaccaaagaacccacaccggcgaaaaacccuauaagugucccgaguguggaaaaagcuucucuagaagcgacaaacucacagagcaccagaggacacacaccggcgagaagcccuacaaaugucccgagugcggcaaaagcuucagcagcaagaagcaccuggccgagcaccaaagaacacacaccggcgaaaaaccuuauaaaugccccgagugcggcaaguccuuuuccaccaagaacucucugacagaacaccaaaggacacacaccggagaaaaacccuacaaaugucccgaauguggcaaauccuucagcgauaagaaggaccucaccagacaccagaggacacacaccggcgaaaaaccuuauaaaugucccgagugcggaaaguccuucuccagcaaaaagcaccucgcugagcaccaaaggacccacaccggcgagaagcccaccggaaaaaagaccagc

SEQ ID NO: 222 - RNA, 627 nt, Artificial Sequence
  source: /note="Description of Artificial Sequence: Synthetic polynucleotide"
cuggagcccggcgaaaagcccuacaaaugucccgaauguggcaagagcuucagcagcaaaaagcaccuggcugaacaccagaggacccacaccggagagaaacccuauaaaugucccgaguguggaaaaagcuucagcacccaccucgaccucauuaggcaccaaagaacccacaccggcgaaaaacccuauaagugucccgaguguggaaaauccuuuucuagaaaggacaaucucaagaaucaccaaagaacacacaccggcgagaaaccuuacaagugucccgagugcggaaaguccuucuccgacuguagagaucuggcuagacaccagagaacccacaccggcgagaagcccuauaagugccccgagugcggcaaguccuucucuagagaggacaaucugcacacacaccagaggacccacaccggcgaaaaaccuuacaaaugccccgaguguggcaagagcuuuagcgaucccggacaccuggugagacaccaaagaacccacaccggcgagaagccuuacaagugucccgaauguggaaaauccuuuagccagcuggcccaccugagggcccaccaaaggacacacaccggcgaaaaacccaccggcaaaaagaccagc

SEQ ID NO: 223 - RNA, 627 nt, Artificial Sequence
  source: /note="Description of Artificial Sequence: Synthetic polynucleotide"
cuggagcccggcgaaaagcccuauaagugccccgagugcggcaagagcuucucuagaagcgacaaacucgugagacaccagagaacacacaccggagagaaaccuuacaagugccccgaguguggcaaguccuucucccaauccggcgaucugaggagacaccagagaacccacaccggcgaaaaacccuacaaaugccccgagugcggaaaguccuuuuccaccuccggcgagcucgugagacaccaaaggacccacaccggcgagaagccuuacaagugccccgagugcggcaaauccuucuccagauccgacaagcucgugaggcaccagaggacacacaccggagagaaaccuuauaagugucccgaauguggaaaguccuucagcgaccccggacaccuggugagacaccagaggacccacaccggcgaaaagccuuauaaaugucccgagugcggaaaaagcuuuucuagaaacgaugcucugacagagcaccaaagaacccacaccggcgaaaaacccuacaagugucccgagugcggaaagagcuucagcagaagcgaccaccugaccaaccaccagagaacacacaccggagaaaaacccaccggcaaaaagaccucc

SEQ ID NO: 224 - RNA, 627 nt, Artificial Sequence
  source: /note="Description of Artificial Sequence: Synthetic polynucleotide"
cuggagcccggcgaaaagcccuacaaaugucccgaaugcggcaaauccuucuccaccuccggccaccucgugagacaccagaggacacacaccggcgagaagccuuauaagugccccgaaugcggcaaaagcuucuccaccaccggcaaucugaccguccaccagagaacacacaccggcgaaaaaccuuauaagugucccgaguguggcaaauccuuuuccaccagcggaucucuggugagacaccaaaggacacacaccggcgaaaaacccuacaaaugccccgaguguggaaaauccuucucuagaagcgacaagcuggugagacaccagaggacccacaccggcgagaaacccuacaagugccccgaauguggcaagagcuucucuagauccgacgagcucgugagacaccaaagaacccacaccggcgaaaagccuuacaaaugucccgagugcggaaagagcuuuagcagaagcgauaagcuggucagacaccaaagaacacacaccggagaaaaacccuauaagugccccgaguguggcaaguccuuuagccagagagcccaccuggagagacaccaaagaacccacaccggcgaaaaacccaccggaaaaaagacaagc

SEQ ID NO: 225 - RNA, 627 nt, Artificial Sequence
  source: /note="Description of Artificial Sequence: Synthetic polynucleotide"
cuggagcccggcgagaagcccuacaaaugucccgaauguggcaagagcuucucuagaaacgacacacugaccgaacaccagagaacacacaccggcgaaaaaccuuauaaaugucccgaguguggaaaauccuucucuagaaaugacgcucucaccgagcaccaaagaacacacaccggcgaaaagccuuacaaaugccccgaauguggaaaguccuucuccaccuccggagagcuggugagacaccagagaacccacaccggcgaaaaacccuacaagugccccgagugcggaaaaagcuucucuagaagcgauaaucuggugagacaccaaaggacacacaccggcgagaagcccuauaagugucccgaaugcggcaaguccuuuuccagaagcgacgaacuggugagacaccagagaacccacaccggagagaagccuuauaagugucccgagugcggaaagagcuuuucuagauccgacaagcucgugagacaccaaaggacccacaccggcgagaaacccuauaaaugucccgaguguggcaaauccuuuucccagagcagcaaccucgugaggcaccagaggacccacaccggcgagaaacccaccggcaaaaagaccagc

SEQ ID NO: 226 - RNA, 627 nt, Artificial Sequence
  source: /note="Description of Artificial Sequence: Synthetic polynucleotide"
uuggaaccgggagagaagccuuauaaguguccggagugugggaagucguucuccaccucgggcaaccucaccgaacaucagcgcacacauacgggggagaaaccuuacaaaugcccggaauguggaaagagcuucuccgauucgggaaaucucagagugcaccaacgcacccacacaggagaaaaaccguauaagugccccgaaugcgggaaaucguucucccacaagaaugcgcugcagaaccaccagaggacacauacuggggagaagcccuacaaguguccugaaugcggaaaguccuucucgcgcaacgauacuuugaccgagcaccagcgcacucacaccggcgaaaagccguacaagugcccagagugcgguaaaagcuucucgcaacgggcccaucuggaacggcaccagcggacucacacuggagaaaagcccuacaagugucccgagugcgggaaguccuuuucccgguccgauaagcucgugcgccaccagagaacccauacuggagagaaaccguacaaauguccagaaugcggcaaauccuucucggacccgggacaccucgugcggcaucaacggacccauaccggggaaaagcccaccggaaagaaaacuagc

SEQ ID NO: 227 - RNA, 627 nt, Artificial Sequence
  source: /note="Description of Artificial Sequence: Synthetic polynucleotide"
cucgaacccggggaaaagccguacaaguguccggagugugggaagucauucuccacuuccgggaaucugaccgagcaucaacgcacccacacuggcgagaagcccuacaaaugcccggagugcggaaaaucguucucggacuccgggaaccuucggguccaccaaaggacucauaccggggagaaaccguacaaaugucccgaaugcgggaagucguucagccauaagaacgcgcugcagaaccaucagaggacccauacuggagaaaagcccuauaaguguccggaaugcggaaagucguucucacgcaacgacacccucaccgaacaccagcgcacucacaccggagagaagccuuacaagugcccggaauguggaaagagcuucagccagcgggcacaucuggaaagacaccagcgaacccacaccggggaaaaaccguauaagugccccgaguguggaaaguccuuuucacgguccgauaagcucgugcgccaccagagaacucacacuggggagaagccguacaagugucccgagugcggcaagagcuucucagauccgggacaccuugugcgacaucaacggacccauaccggagaaaaaccgaccgggaaaaagaccuca

SEQ ID NO: 228 - RNA, 627 nt, Artificial Sequence
  source: /note="Description of Artificial Sequence: Synthetic polynucleotide"
cuggaaccgggggaaaaacccuacaagugcccggaaugcggcaagagcuucucgaccuccgggaaccugaccgagcaccagcgcacccacaccggagagaaaccguacaagugccccgaaugcgggaaaucguucucagacucgggaaaccucagggugcaccagcggacccacacgggggaaaagccguacaaaugcccggagugcgggaagucauucucccacaagaacgcgcugcagaaccaccaaagaacccacaccggcgaaaaaccguacaagugccccgagugcggaaaguccuucucccgcaacgacacccucaccgaacaccaacgcacccacaccggagaaaagcccuacaagugcccggaaugcggaaagagcuucagccagagggcccaccuggaaagacaccagagaacccacaccggcgaaaagccguacaaaugcccggagugcgggaaguccuucagccggucagacaagcugguccgccaccaaaggacccacacaggagaaaagcccuacaagugcccggaaugcggaaaaucguucagcgaccccggacaccugguccggcaccagaggacccacaccggggagaagccgaccggcaaaaagaccuca

SEQ ID NO: 229 - RNA, 627 nt, Artificial Sequence
  source: /note="Description of Artificial Sequence: Synthetic polynucleotide"
cuggaacccggagaaaaacccuacaagugcccagaaugcggcaagagcuucagcaccagcggaaaccugaccgaacaccagcggacgcacacaggggagaaaccguacaaaugcccggagugcggaaagagcuucagcgacagcggcaaccuccgcgugcaccagagaacccacacgggagagaagccguacaagugcccggaaugcggaaaaagcuucagccacaagaacgcgcugcagaaccaccagaggacacacacgggcgagaagcccuacaaaugccccgaaugcgggaaaagcuucagccggaacgacacccucaccgagcaccagcgaacccacaccggagaaaagccguacaagugcccggaaugcggaaaaagcuucagccaacgggcccaccuggaacgccaccaaaggacccacacaggagaaaagcccuacaagugcccagagugcggcaaaagcuucagccggagcgacaagcugguccggcaccagcgcacacacaccggcgaaaagccauacaagugccccgagugcggaaagagcuucagcgacccaggacaccucgugcggcaccaacgcacgcacaccggggaaaaaccgaccggaaaaaagaccagc

SEQ ID NO: 230 - RNA, 627 nt, Artificial Sequence
  source: /note="Description of Artificial Sequence: Synthetic polynucleotide"
cuggaaccuggggagaaacccuauaagugcccggagugcggaaagucauucucaacuagcggaaaccugacagagcaccagaggacccauacuggcgaaaagccauacaaaugccccgaaugcgggaaaagcuucagcgacagcgggaaccugagagugcaccagcggacucauaccggggagaagccuuacaagugccccgaguguggaaaguccuucucccauaagaacgcgcuccagaaccaccagagaacccacaccggagaaaagccguacaagugcccggaaugcggcaaauccuuuucacggaacgacacucucaccgagcaccaacggacgcacaccggagagaagccguacaagugcccugaaugcggaaagagcuuuagccagagggcccaccuggaacggcaucagcgcacucacaccggggaaaagcccuacaagugcccagagugcggcaagagcuucucccggucugacaagcuugugcgccaucagcggacccacacuggagaaaaaccguacaaguguccggaguguggcaaaucguucucagacccgggacaccugguccgacaccaacgcacacacaccggcgaaaagccgaccggcaaaaagaccucg

SEQ ID NO: 231 - RNA, 627 nt, Artificial Sequence
  source: /note="Description of Artificial Sequence: Synthetic polynucleotide"
cuggaacccggggagaagccguacaagugcccagaaugcggaaagagcuucagcaccagcggcaaccucaccgagcaccagagaacccacaccggggagaaaccguacaaaugcccggaaugcggcaagagcuucagcgacagcggaaaccugagagugcaccaacgcacccacacgggagaaaaacccuacaaaugccccgagugcgggaaaagcuucagccacaagaacgcgcugcagaaccaccaaagaacgcacaccggagaaaagccguacaagugcccagaaugcggaaagagcuucagcagaaacgacacccugaccgaacaccagcggacgcacacaggcgaaaaaccauacaagugcccggagugcggcaaaagcuucagccagagagcgcaccuggaaaggcaccagcgcacacacaccggcgaaaagccauacaaaugcccagagugcggaaaaagcuucagccggagcgacaagcugguccgccaccaacggacccacacaggggaaaagcccuacaagugccccgaaugcggcaagagcuucagcgacccgggacaccucgugcggcaccagaggacccacaccggagaaaagccgaccgggaaaaagaccagc

SEQ ID NO: 232 - RNA, 627 nt, Artificial Sequence; identical to SEQ ID NO: 214
  source: /note="Description of Artificial Sequence: Synthetic polynucleotide"

SEQ ID NO: 233 - RNA, 627 nt, Artificial Sequence; identical to SEQ ID NO: 217
  source: /note="Description of Artificial Sequence: Synthetic polynucleotide"

SEQ ID NO: 234 - RNA, 627 nt, Artificial Sequence
  source: /note="Description of Artificial Sequence: Synthetic polynucleotide"
cuggaaccgggggaaaaacccuacaagugcccggaaugcggcaagagcuucucgcgguccgaccaccugaccaaccaccagagaacacacaccggcgagaagccguacaagugccccgagugcgggaagucguucagcaccucaggaucgcugguccgccaccaacggacccacacaggagaaaagcccuacaagugcccggaaugcggaaagagcuucagccaagccgggcaccuggcaucacaccagcgaacccacaccggagaaaaaccguacaaaugcccggagugcggcaaauccuucucgcgcuccgacaagcugaccgaacaccaaaggacacacaccggagagaagcccuacaagugcccggaaugcggaaaaucguucucgaccucggggaaccugaccgagcaccaacgcacccacaccggcgaaaaaccguacaaaugcccggagugcggaaagucguucucacaauccuccaaccugguccggcaccaaagaacgcacacaggggaaaagccguacaagugccccgaaugcgggaaauccuucagcacccaccuggaccucauccggcaccagaggacccacaccggggagaagccgaccggcaaaaagaccuca

SEQ ID NO: 235 - RNA, 627 nt, Artificial Sequence; identical to SEQ ID NO: 215
  source: /note="Description of Artificial Sequence: Synthetic polynucleotide"

SEQ ID NO: 236 - RNA, 627 nt, Artificial Sequence; identical to SEQ ID NO: 228
  source: /note="Description of Artificial Sequence: Synthetic polynucleotide"

SEQ ID NO: 237 - DNA, 627 bp, Artificial Sequence
  source: /note="Description of Artificial Sequence: Synthetic polynucleotide"
ctggaaccgggcgagaagccatacaagtgcccagagtgcggcaaaagcttcagccgcagcgaccatctgaccaatcaccaacgcacccataccggtgagaagccgtacaaatgcccagagtgcggtaagagctttagtaccagtggcagtctggttcgtcatcagcgcacgcacacgggcgaaaaaccatacaaatgcccggagtgcggcaaaagctttagccaagccggtcatctggcgagccatcaacgtacgcacaccggcgagaagccgtataaatgtccggagtgcggtaagagctttagccgtagcgataaactgaccgaacaccaacgtacgcatacgggcgagaaaccatataaatgtccagagtgtggcaagagtttcagcaccagcggcaatctgaccgagcatcaacgtacccataccggtgaaaagccatataaatgtccagaatgcggtaagagttttagtcagagcagtaatctggtgcgccatcagcgtacccacacgggtgagaaaccatataagtgtccggaatgcggcaagagttttagcacccatctggatctgatccgtcatcagcgcacccacaccggtgaaaaaccaaccggcaagaaaaccagt

SEQ ID NO: 238 - RNA, 627 nt, Artificial Sequence; identical to SEQ ID NO: 217
  source: /note="Description of Artificial Sequence: Synthetic polynucleotide"

SEQ ID NO: 239 - DNA, 627 bp, Artificial Sequence
  source: /note="Description of Artificial Sequence: Synthetic polynucleotide"
ctggaaccgggggaaaaaccctacaagtgcccggaatgcggcaagagcttctcgacctccgggaacctgaccgagcaccagcgcacccacaccggagagaaaccgtacaagtgccccgaatgcgggaaatcgttctcagactcgggaaacctcagggtgcaccagcggacccacacgggggaaaagccgtacaaatgcccggagtgcgggaagtcattctcccacaagaacgcgctgcagaaccaccaaagaacccacaccggcgaaaaaccgtacaagtgccccgagtgcggaaagtccttctcccgcaacgacaccctcaccgaacaccaacgcacccacaccggagaaaagccctacaagtgcccggaatgcggaaagagcttcagccagagggcccacctggaaagacaccagagaacccacaccggcgaaaagccgtacaaatgcccggagtgcgggaagtccttcagccggtcagacaagctggtccgccaccaaaggacccacacaggagaaaagccctacaagtgcccggaatgcggaaaatcgttcagcgaccccggacacctggtccggcaccagaggacccacaccggggagaagccgaccggcaaaaagacctca

SEQ ID NO: 240 - RNA, 627 nt, Artificial Sequence; identical to SEQ ID NO: 228
  source: /note="Description of Artificial Sequence: Synthetic polynucleotide"

SEQ ID NO: 241 - DNA, 627 bp, Artificial Sequence; identical to SEQ ID NO: 237
  source: /note="Description of Artificial Sequence: Synthetic polynucleotide"

SEQ ID NO: 242 - RNA, 627 nt, Artificial Sequence; identical to SEQ ID NO: 217
  source: /note="Description of Artificial Sequence: Synthetic polynucleotide"

SEQ ID NO: 243 - DNA, 627 bp, Artificial Sequence; identical to SEQ ID NO: 239
  source: /note="Description of Artificial Sequence: Synthetic polynucleotide"

SEQ ID NO: 244 - RNA, 2406 nt, Artificial Sequence
  source: /note="Description of Artificial Sequence: Synthetic polynucleotide"
ggaucccauaugguugaucugcguacccuggguuauagccagcagcagcaagaaaaaaucaaaccgaaaguucguagcaccguugcacagcaucaugaagcacugguuggucaugguuuuacccaugcacauauuguugcacugagccagcauccggcagcacugggcaccguugcaguuaaauaucaggauaugauugcagcacugccggaagcaacccaugaagcaauuguugguguugguaaacgcggagcuggugcacgugcccuggaagcacugcugaccguugccggugaacugcgugguccgccucugcagcuggauaccggucagcugcugaaaauugcaaaacguggugguguuaccgcaguugaagcaguucaugcauggcguaaugcacugaccggugcaccgcugaaucugacaccggaacagguuguugcaauugccagccaugaugguggcaaacaggcacuggaaaccguucagcgucugcugccgguucugugucaggcacauggucugaccccugaacaggugguggccauugcaagcaauaauggcgguaaacaagcccuggaaacagugcagcgccuguuaccggugcugugccaggcccauggcuuaacuccggaacaggugguagcgaucgcaucaaacaauggagguaaacaggccuuagaaaccguacagcgcuuacugccgguguuaugccaggcgcacggccugacgccagaacagguaguggcaaucgccucacaugacgguggaaaacaggcguuagagacaguccagcgccugcugccuguauuaugucaagcccauggccugaccccagagcaaguuguugcgauugcaaguaauaauggggguaaacaggcacuugagacaguucaacguuuacugccuguacugugccaagcucacggucugacuccggaacaagucgucgcgauugcgaguaauggugguggcaaacaagcauuagaaacggugcaacgccugcugccaguucuuugccaggcucacgguuuaaccccugagcagguuguagcuauugcgaguaacaauggugguaagcaggcguuggaaacugugcaaagacugcugcccguguugugccaagcacaugguuuaaccccagaacaagucguagcaaucgcaagcaauaaugguggcaagcaagcgcuugaaacaguacagcguuuauuaccgguacuuugucaggcccacggucuuacaccagaacaaguuguggccauagccaguaacauuggcggaaagcaggcucuggaaacgguacaacgucuguuaccuguucugugucaagcgcacggauuaacaccugaacaaguaguugccauugcgucaaauaauggaggcaagcaggccuuggagacagugcagagauuacugccaguguugugucaggcucauggccuuacacccgagcaggucguggcaauugcaucuaacaauggcgguaagcaagcuuuagagacuguucagagacugcuuccuguccugugccaggcacacggacuuacgccugagcaagugguugcaaucgccucucaugauggugguaagcaagcacuggaaacuguccaacgcuuacuuccggugcuuugucaagcacacggcuuaacgccagagcaggucgucgccauagccagcaauauaggugguaaacaggcccuugaaacgguccaaagacuucugccgguccuuugccaagcgcaugggcugacaccugagcagguagucgcgauugccucaaauaauggugggaagcaggcauuagaaacaguucaaagauuauuaccaguccugugucaggcgcauggguuaaccccagagcagguaguugcaauagcauccaacaauggcggaaaacaagcguuggaaacgguucagcgguuauugccuguuuugugccaggcgcaugguuugacacccgagcaagugguagccauagccucaaauaauggggguaaacaagcuuuggagacaguacaacggcugcuuccaguuuuaugucaggcccauggauugacgccugaacaaguugucgcuaucgcaaguaauaucggugguaaacaagcgcuugaaaccguucaacgccuucugccugugcuuugucaggcacauggauuaacacccgaacagguugucgcgauagcuucaaacaaugguggucguccggcacuggaaagcauuguugcacagcugagccguccugauccggcacuggcagcacugaccaaugaucaucugguugcacuggcaugucuggguggucgcccugcccuggaugcaguuaaaaaaggucugccgcaugcaccggcacugauuaaacguaccaaucgucguauuccggaacguaccagccaucguguugcuagc

SEQ ID NO: 245 - RNA, 2406 nt, Artificial Sequence
  source: /note="Description of Artificial Sequence: Synthetic polynucleotide"
ggaucccauaugguugaucugcguacccuggguuauagccagcagcagcaagaaaaaaucaaaccgaaaguucguagcaccguugcacagcaucaugaagcacugguuggucaugguuuuacccaugcacauauuguugcacugagccagcauccggcagcacugggcaccguugcaguuaaauaucaggauaugauugcagcacugccggaagcaacccaugaagcaauuguugguguugguaaacgcggagcuggugcacgugcccuggaagcacugcugaccguugccggugaacugcgugguccgccucugcagcuggauaccggucagcugcugaaaauugcaaaacguggugguguuaccgcaguugaagcaguucaugcauggcguaaugcacugaccggugcaccgcugaaucugacaccggaacagguuguugcaauugccagcaauggugguggcaaacaggcacuggaaaccguucagcgucugcugccgguucugugucaggcacauggucugaccccugaacaggugguggccauugcaagcaauggcggcgguaaacaagcccuggaaacagugcagcgccuguuaccggugcugugccaggcccauggcuuaacuccggaacaggugguagcgaucgcaucacaugauggagguaaacaggccuuagaaaccguacagcgcuuacugccgguguuaugccaggcgcacggccugacgccagaacagguaguggcaaucgccucaaauaaugguggaaaacaggcguuagagacaguccagcgccugcugccuguauuaugucaagcccauggccugaccccagagcaaguuguugcgauugcaaguaacaauggggguaaacaggcacuugagacaguucaacguuuacugccuguacugugccaagcucacggucugacuccggaacaagucgucgcgauugcgaguaauaaugguggcaaacaagcauuagaaacggugcaacgccugcugccaguucuuugccaggcucacgguuuaaccccugagcagguuguagcuauugcgaguaacaauggugguaagcaggcguuggaaacugugcaaagacugcugcccguguugugccaagcacaugguuuaaccccagaacaagucguagcaaucgcaagcaauggggguggcaagcaagcgcuugaaacaguacagcguuuauuaccgguacuuugucaggcccacggucuuacaccagaacaaguuguggccauagccaguaauaauggcggaaagcaggcucuggaaacgguacaacgucuguuaccuguucugugucaagcgcacggauuaacaccugaacaaguaguugccauugcgucaaacaauggaggcaagcaggccuuggagacagugcagagauuacugccaguguugugucaggcucauggccuuacacccgagcaggucguggcaauugcaucuaauaauggcgguaagcaagcuuuagagacuguucagagacugcuuccuguccugugccaggcacacggacuuacgccugagcaagugguugcaaucgccucucaugauggugguaagcaagcacuggaaacuguccaacgcuuacuuccggugcuuugucaagcacacggcuuaacgccagagcaggucgucgccauagccagcaacaauggugguaaacaggcccuugaaacgguccaaagacuucugccgguccuuugccaagcgcaugggcugacaccugagcagguagucgcgauugccucacaugacggugggaagcaggcauuagaaacaguucaaagauuauuaccaguccugugucaggcgcauggguuaaccccagagcagguaguugcaauagcaucccaugauggcggaaaacaagcguuggaaacgguucagcgguuauugccuguuuugugccaggcgcaugguuugacacccgagcaagugguagccauagccucacaugacggggguaaacaagcuuuggagacaguacaacggcugcuuccaguuuuaugucaggcccauggauugacgccugaacaaguugucgcuaucgcaaguaacauuggugguaaacaagcgcuugaaaccguucaacgccuucugccugugcuuugucaggcacauggauuaacacccgaacagguugucgcgauagcuucaaacaaugguggucguccggcacuggaaagcauuguugcacagcugagccguccugauccggcacuggcagcacugaccaaugaucaucugguugcacuggcaugucuggguggucgcccugcccuggaugcaguuaaaaaaggucugccgcaugcaccggcacugauuaaacguaccaaucgucguauuccggaacguaccagccaucguguugcuagc

SEQ ID NO: 246 - RNA, 2406 nt, Artificial Sequence
  source: /note="Description of Artificial Sequence: Synthetic polynucleotide"
ggaucccauaugguugaucugcguacccuggguuauagccagcagcagcaagaaaaaaucaaaccgaaaguucguagcaccguugcacagcaucaugaagcacugguuggucaugguuuuacccaugcacauauuguugcacugagccagcauccggcagcacugggcaccguugcaguuaaauaucaggauaugauugcagcacugccggaagcaacccaugaagcaauuguugguguugguaaacgcggagcuggugcacgugcccuggaagcacugcugaccguugccggugaacugcgugguccgccucugcagcuggauaccggucagcugcugaaaauugcaaaacguggugguguuaccgcaguugaagcaguucaugcauggcguaaugcacugaccggugcaccgcugaaucugacaccggaacagguuguugcaauugccagcaauaaugguggcaaacaggcacuggaaaccguucagcgucugcugccgguucugugucaggcacauggucugaccccugaacaggugguggccauugcaagcaaugguggcgguaaacaagcccuggaaacagugcagcgccuguuaccggugcugugccaggcccauggcuuaacuccggaacaggugguagcgaucgcaucaaauggcggagguaaacaggccuuagaaaccguacagcgcuuacugccgguguuaugccaggcgcacggccugacgccagaacagguaguggcaaucgccucaaauggggguggaaaacaggcguuagagacaguccagcgccugcugccuguauuaugucaagcccauggccugaccccagagcaaguuguugcgauugcaaguaacaauggggguaaacaggcacuugagacaguucaacguuuacugccuguacugugccaagcucacggucugacuccggaacaagucgucgcgauugcgaguaacauugguggcaaacaagcauuagaaacggugcaacgccugcugccaguucuuugccaggcucacgguuuaaccccugagcagguuguagcuauugcgaguaauaucggugguaagcaggcguuggaaacugugcaaagacugcugcccguguugugccaagcacaugguuuaaccccagaacaagucguagcaaucgcaagcaauauagguggcaagcaagcgcuugaaacaguacagcguuuauuaccgguacuuugucaggcccacggucuuacaccagaacaaguuguggccauagccaguaauaauggcggaaagcaggcucuggaaacgguacaacgucuguuaccuguucugugucaagcgcacggauuaacaccugaacaaguaguugccauugcgucaaacaauggaggcaagcaggccuuggagacagugcagagauuacugccaguguugugucaggcucauggccuuacacccgagcaggucguggcaauugcaucuaacauuggcgguaagcaagcuuuagagacuguucagagacugcuuccuguccugugccaggcacacggacuuacgccugagcaagugguugcaaucgccucuaauaucggugguaagcaagcacuggaaacuguccaacgcuuacuuccggugcuuugucaagcacacggcuuaacgccagagcaggucgucgccauagccagcaauaauggugguaaacaggcccuugaaacgguccaaagacuucugccgguccuuugccaagcgcaugggcugacaccugagcagguagucgcgauugccucaaacaauggugggaagcaggcauuagaaacaguucaaagauuauuaccaguccugugucaggcgcauggguuaaccccagagcagguaguugcaauagcaucccaugauggcggaaaacaagcguuggaaacgguucagcgguuauugccuguuuugugccaggcgcaugguuugacacccgagcaagugguagccauagccucaaauauaggggguaaacaagcuuuggagacaguacaacggcugcuuccaguuuuaugucaggcccauggauugacgccugaacaaguugucgcuaucgcaaguaauaauggugguaaacaagcgcuugaaaccguucaacgccuucugccugugcuuugucaggcacauggauuaacacccgaacagguugucgcgauagcuucaaacauugguggucguccggcacuggaaagcauuguugcacagcugagccguccugauccggcacuggcagcacugaccaaugaucaucugguugcacuggcaugucuggguggucgcccugcccuggaugcaguuaaaaaaggucugccgcaugcaccggcacugauuaaacguaccaaucgucguauuccggaacguaccagccaucguguugcuagc

SEQ ID NO: 247 - RNA, 2406 nt, Artificial Sequence
  source: /note="Description of Artificial Sequence: Synthetic polynucleotide"
ggaucccauaugguugaucugcguacccuggguuauagccagcagcagcaagaaaaaaucaaaccgaaaguucguagcaccguugcacagcaucaugaagcacugguuggucaugguuuuacccaugcacauauuguugcacugagccagcauccggcagcacugggcaccguugcaguuaaauaucaggauaugauugcagcacugccggaagcaacccaugaagcaauuguugguguugguaaacgcggagcuggugcacgugcccuggaagcacugcugaccguugccggugaacugcgugguccgccucugcagcuggauaccggucagcugcugaaaauugcaaaacguggugguguuaccgcaguugaagcaguucaugcauggcguaaugcacugaccggugcaccgcugaaucugacaccggaacagguuguugcaauugccagccaugaugguggcaaacaggcacuggaaaccguucagcgucugcugccgguucugugucaggcacauggucugaccccugaacaggugguggccauugcaagccaugacggcgguaaacaagcccuggaaacagugcagcgccuguuaccggugcugugccaggcccauggcuuaacuccggaacaggugguagcgaucgcaucaaacauuggagguaaacaggccuuagaaaccguacagcgcuuacugccgguguuaugccaggcgcacggccugacgccagaacagguaguggcaaucgccucaaauaaugguggaaaacaggcguuagagacaguccagcgccugcugccuguauuaugucaagcccauggccugaccccagagcaaguuguugcgauugcaagucaugauggggguaaacaggcacuugagacaguucaacguuuacugccuguacugugccaagcucacggucugacuccggaacaagucgucgcgauugcgaguaauaucgguggcaaacaagcauuagaaacggugcaacgccugcugccaguucuuugccaggcucacgguuuaaccccugagcagguuguagcuauugcgaguaacaauggugguaagcaggcguuggaaacugugcaaagacugcugcccguguugugccaagcacaugguuuaaccccagaacaagucguagcaaucgcaagcaauauagguggcaagcaagcgcuugaaacaguacagcguuuauuaccgguacuuugucaggcccacggucuuacaccagaacaaguuguggccauagccaguaaugguggcggaaagcaggcucuggaaacgguacaacgucuguuaccuguucugugucaagcgcacggauuaacaccugaacaaguaguugccauugcgucacaugacggaggcaagcaggccuuggagacagugcagagauuacugccaguguugugucaggcucauggccuuacacccgagcaggucguggcaauugcaucuaauggcggcgguaagcaagcuuuagagacuguucagagacugcuuccuguccugugccaggcacacggacuuacgccugagcaagugguugcaaucgccucuaaugggggugguaagcaagcacuggaaacuguccaacgcuuacuuccggugcuuugucaagcacacggcuuaacgccagagcaggucgucgccauagccagccaugauggugguaaacaggcccuugaaacgguccaaagacuucugccgguccuuugccaagcgcaugggcugacaccugagcagguagucgcgauugccucacaugacggugggaagcaggcauuagaaacaguucaaagauuauuaccaguccugugucaggcgcauggguuaaccccagagcagguaguugcaauagcaucccaugauggcggaaaacaagcguuggaaacgguucagcgguuauugccuguuuugugccaggcgcaugguuugacacccgagcaagugguagccauagccucaaacauuggggguaaacaagcuuuggagacaguacaacggcugcuuccaguuuuaugucaggcccauggauugacgccugaacaaguugucgcuaucgcaaguaauaauggugguaaacaagcgcuugaaaccguucaacgccuucugccugugcuuugucaggcacauggauuaacacccgaacagguugucgcgauagcuucaaauaucgguggucguccggcacuggaaagcauuguugcacagcugagccguccugauccggcacuggcagcacugaccaaugaucaucugguugcacuggcaugucuggguggucgcccugcccuggaugcaguuaaaaaaggucugccgcaugcaccggcacugauuaaacguaccaaucgucguauuccggaacguaccagccaucguguugcuagc

SEQ ID NO: 248 - RNA, 2406 nt, Artificial Sequence
  source: /note="Description of Artificial Sequence: Synthetic polynucleotide"
ggaucccauaugguugaucugcguacccuggguuauagccagcagcagcaagaaaaaaucaaaccgaaaguucguagcaccguugcacagcaucaugaagcacugguuggucaugguuuuacccaugcacauauuguugcacugagccagcauccggcagcacugggcaccguugcaguuaaauaucaggauaugauugcagcacugccggaagcaacccaugaagcaauuguugguguugguaaacgcggagcuggugcacgugcccuggaagcacugcugaccguugccggugaacugcgugguccgccucugcagcuggauaccggucagcugcugaaaauugcaaaacguggugguguuaccgcaguugaagcaguucaugcauggcguaaugcacugaccggugcaccgcugaaucugacaccggaacagguuguugcaauugccagcaauaaugguggcaaacaggcacuggaaaccguucagcgucugcugccgguucugugucaggcacauggucugaccccugaacaggugguggccauugcaagcaacaauggcgguaaacaagcccuggaaacagugcagcgccuguuaccggugcugugccaggcccauggcuuaacuccggaacaggugguagcgaucgcaucaaauaauggagguaaacaggccuuagaaaccguacagcgcuuacugccgguguuaugccaggcgcacggccugacgccagaacagguaguggcaaucgccucaaacaaugguggaaaacaggcguuagagacaguccagcgccugcugccuguauuaugucaagcccauggccugaccccagagcaaguuguugcgauugcaaguaauaauggggguaaacaggcacuugagacaguucaacguuuacugccuguacugugccaagcucacggucugacuccggaacaagucgucgcgauugcgaguaacauugguggcaaacaagcauuagaaacggugcaacgccugcugccaguucuuugccaggcucacgguuuaaccccugagcagguuguagcuauugcgagucaugauggugguaagcaggcguuggaaacugugcaaagacugcugcccguguugugccaagcacaugguuuaaccccagaacaagucguagcaaucgcaagccaugacgguggcaagcaagcgcuugaaacaguacagcguuuauuaccgguacuuugucaggcccacggucuuacaccagaacaaguuguggccauagccaguaacaauggcggaaagcaggcucuggaaacgguacaacgucuguuaccuguucugugucaagcgcacggauuaacaccugaacaaguaguugccauugcgucaaauaucggaggcaagcaggccuuggagacagugcagagauuacugccaguguugugucaggcucauggccuuacacccgagcaggucguggcaauugcaucuaaugguggcgguaagcaagcuuuagagacuguucagagacugcuuccuguccugugccaggcacacggacuuacgccugagcaagugguugcaaucgccucuaauggcggugguaagcaagcacuggaaacuguccaacgcuuacuuccggugcuuugucaagcacacggcuuaacgccagagcaggucgucgccauagccagcaauauaggugguaaacaggcccuugaaacgguccaaagacuucugccgguccuuugccaagcgcaugggcugacaccugagcagguagucgcgauugccucaaacauuggugggaagcaggcauuagaaacaguucaaagauuauuaccaguccugugucaggcgcauggguuaaccccagagcagguaguugcaauagcaucccaugauggcggaaaacaagcguuggaaacgguucagcgguuauugccuguuuugugccaggcgcaugguuugacacccgagcaagugguagccauagccucacaugacggggguaaacaagcuuuggagacaguacaacggcugcuuccaguuuuaugucaggcccauggauugacgccugaacaaguugucgcuaucgcaaguaauaucggugguaaacaagcgcuugaaaccguucaacgccuucugccugugcuuugucaggcacauggauuaacacccgaacagguugucgcgauagcuucaaauggggguggucguccggcacuggaaagcauuguugcacagcugagccguccugauccggcacuggcagcacugaccaaugaucaucugguugcacuggcaugucuggguggucgcccugcccuggaugcaguuaaaaaaggucugccgcaugcaccggcacugauuaaacguaccaaucgucguauuccggaacguaccagccaucguguugcuagc

SEQ ID NO: 249 - RNA, 2406 nt, Artificial Sequence
  source: /note="Description of Artificial Sequence: Synthetic polynucleotide"
ggaucccauaugguugaucugcguacccuggguuauagccagcagcagcaagaaaaaaucaaaccgaaaguucguagcaccguugcacagcaucaugaagcacugguuggucaugguuuuacccaugcacauauuguugcacugagccagcauccggcagcacugggcaccguugcaguuaaauaucaggauaugauugcagcacugccggaagcaacccaugaagcaauuguugguguugguaaacgcggagcuggugcacgugcccuggaagcacugcugaccguugccggugaacugcgugguccgccucugcagcuggauaccggucagcugcugaaaauugcaaaacguggugguguuaccgcaguugaagcaguucaugcauggcguaaugcacugaccggugcaccgcugaaucugacaccggaacagguuguugcaauugccagcaauaaugguggcaaacaggcacuggaaaccguucagcgucugcugccgguucugugucaggcacauggucugaccccugaacaggugguggccauugcaagcaacaauggcgguaaacaagcccuggaaacagugcagcgccuguuaccggugcugugccaggcccauggcuuaacuccggaacaggugguagcgaucgcaucaaaugguggagguaaacaggccuuagaaaccguacagcgcuuacugccgguguuaugccaggcgcacggccugacgccagaacagguaguggcaaucgccucaaauaaugguggaaaacaggcguuagagacaguccagcgccugcugccuguauuaugucaagcccauggccugaccccagagcaaguuguugcgauugcaaguaauggcggggguaaacaggcacuugagacaguucaacguuuacugccuguacugugccaagcucacggucugacuccggaacaagucgucgcgauugcgagucaugaugguggcaaacaagcauuagaaacggugcaacgccugcugccaguucuuugccaggcucacgguuuaaccccugagcagguuguagcuauugcgaguaacauuggugguaagcaggcguuggaaacugugcaaagacugcugcccguguugugccaagcacaugguuuaaccccagaacaagucguagcaaucgcaagcaacaaugguggcaagcaagcgcuugaaacaguacagcguuuauuaccgguacuuugucaggcccacggucuuacaccagaacaaguuguggccauagccagucaugacggcggaaagcaggcucuggaaacgguacaacgucuguuaccuguucugugucaagcgcacggauuaacaccugaacaaguaguugccauugcgucacaugauggaggcaagcaggccuuggagacagugcagagauuacugccaguguugugucaggcucauggccuuacacccgagcaggucguggcaauugcaucuaauaucggcgguaagcaagcuuuagagacuguucagagacugcuuccuguccugugccaggcacacggacuuacgccugagcaagugguugcaaucgccucuaauaauggugguaagcaagcacuggaaacuguccaacgcuuacuuccggugcuuugucaagcacacggcuuaacgccagagcaggucgucgccauagccagcaauauaggugguaaacaggcccuugaaacgguccaaagacuucugccgguccuuugccaagcgcaugggcugacaccugagcagguagucgcgauugccucaaacauuggugggaagcaggcauuagaaacaguucaaagauuauuaccaguccugugucaggcgcauggguuaaccccagagcagguaguugcaauagcauccaauaucggcggaaaacaagcguuggaaacgguucagcgguuauugccuguuuugugccaggcgcaugguuugacacccgagcaagugguagccauagccucacaugauggggguaaacaagcuuuggagacaguacaacggcugcuuccaguuuuaugucaggcccauggauugacgccugaacaaguugucgcuaucgcaagucaugacggugguaaacaagcgcuugaaaccguucaacgccuucugccugugcuuugucaggcacauggauuaacacccgaacagguugucgcgauagcuucaaauauagguggucguccggcacuggaaagcauuguugcacagcugagccguccugauccggcacuggcagcacugaccaaugaucaucugguugcacuggcaugucuggguggucgcccugcccuggaugcaguuaaaaaaggucugccgcaugcaccggcacugauuaaacguaccaaucgucguauuccggaacguaccagccaucguguugcuagc

SEQ ID NO: 250 - RNA, 2406 nt, Artificial Sequence
  source: /note="Description of Artificial Sequence: Synthetic polynucleotide"
ggaucccauaugguugaucugcguacccuggguuauagccagcagcagcaagaaaaaaucaaaccgaaaguucguagcaccguugcacagcaucaugaagcacugguuggucaugguuuuacccaugcacauauuguugcacugagccagcauccggcagcacugggcaccguugcaguuaaauaucaggauaugauugcagcacugccggaagcaacccaugaagcaauuguugguguugguaaacgcggagcuggugcacgugcccuggaagcacugcugaccguugccggugaacugcgugguccgccucugcagcuggauaccggucagcugcugaaaauugcaaaacguggugguguuaccgcaguugaagcaguucaugcauggcguaaugcacugaccggugcaccgcugaaucugacaccggaacagguuguugcaauugccagccaugaugguggcaaacaggcacuggaaaccguucagcgucugcugccgguucugugucaggcacauggucugaccccugaacaggugguggccauugcaagcaaugguggcgguaaacaagcccuggaaacagugcagcgccuguuaccggugcugugccaggcccauggcuuaacuccggaacaggugguagcgaucgcaucaaauaauggagguaaacaggccuuagaaaccguacagcgcuuacugccgguguuaugccaggcgcacggccugacgccagaacagguaguggcaaucgccucaaacauugguggaaaacaggcguuagagacaguccagcgccugcugccuguauuaugucaagcccauggccugaccccagagcaaguuguugcgauugcaaguaauaucggggguaaacaggcacuugagacaguucaacguuuacugccuguacugugccaagcucacggucugacuccggaacaagucgucgcgauugcgagucaugacgguggcaaacaagcauuagaaacggugcaacgccugcugccaguucuuugccaggcucacgguuuaaccccugagcagguuguagcuauugcgaguaauauaggugguaagcaggcguuggaaacugugcaaagacugcugcccguguugugccaagcacaugguuuaaccccagaacaagucguagcaaucgcaagcaauggcgguggcaagcaagcgcuugaaacaguacagcguuuauuaccgguacuuugucaggcccacggucuuacaccagaacaaguuguggccauagccagucaugauggcggaaagcaggcucuggaaacgguacaacgucuguuaccuguucugugucaagcgcacggauuaacaccugaacaaguaguugccauugcgucaaauaauggaggcaagcaggccuuggagacagugcagagauuacugccaguguugugucaggcucauggccuuacacccgagcaggucguggcaauugcaucuaacaauggcgguaagcaagcuuuagagacuguucagagacugcuuccuguccugugccaggcacacggacuuacgccugagcaagugguugcaaucgccucuaaugggggugguaagcaagcacuggaaacuguccaacgcuuacuuccggugcuuugucaagcacacggcuuaacgccagagcaggucgucgccauagccagcaauaauggugguaaacaggcccuugaaacgguccaaagacuucugccgguccuuugccaagcgcaugggcugacaccugagcagguagucgcgauugccucaaacauuggugggaagcaggcauuagaaacaguucaaagauuauuaccaguccugugucaggcgcauggguuaaccccagagcagguaguugcaauagcauccaacaauggcggaaaacaagcguuggaaacgguucagcgguuauugccuguuuugugccaggcgcaugguuugacacccgagcaagugguagccauagccucaaacgguggggguaaacaagcuuuggagacaguacaacggcugcuuccaguuuuaugucaggcccauggauugacgccugaacaaguugucgcuaucgcaaguaaugguggugguaaacaagcgcuugaaaccguucaacgccuucugccugugcuuugucaggcacauggauuaacacccgaacagguugucgcgauagcuucaaauaucgguggucguccggcacuggaaagcauuguugcacagcugagccguccugauccggcacuggcagcacugaccaaugaucaucugguugcacuggcaugucuggguggucgcccugcccuggaugcaguuaaaaaaggucugccgcaugcaccggcacugauuaaacguaccaaucgucguauuccggaacguaccagccaucguguugcuagc

SEQ ID NO: 251 - RNA, 2406 nt, Artificial Sequence
  source: /note="Description of Artificial Sequence: Synthetic polynucleotide"
ggaucccauaugguugaucugcguacccuggguuauagccagcagcagcaagaaaaaaucaaaccgaaaguucguagcaccguugcacagcaucaugaagcacugguuggucaugguuuuacccaugcacauauuguugcacugagccagcauccggcagcacugggcaccguugcaguuaaauaucaggauaugauugcagcacugccggaagcaacccaugaagcaauuguugguguugguaaacgcggagcuggugcacgugcccuggaagcacugcugaccguugccggugaacugcgugguccgccucugcagcuggauaccggucagcugcugaaaauugcaaaacguggugguguuaccgcaguugaagcaguucaugcauggcguaaugcacugaccggugcaccgcugaaucugacaccggaacagguuguugcaauugccagccaugaugguggcaaacaggcacuggaaaccguucagcgucugcugccgguucugugucaggcacauggucugaccccugaacaggugguggccauugcaagcaaugguggcgguaaacaagcccuggaaacagugcagcgccuguuaccggugcugugccaggcccauggcuuaacuccggaacaggugguagcgaucgcaucaaauggcggagguaaacaggccuuagaaaccguacagcgcuuacugccgguguuaugccaggcgcacggccugacgccagaacagguaguggcaaucgccucaaauaaugguggaaaacaggcguuagagacaguccagcgccugcugccuguauuaugucaagcccauggccugaccccagagcaaguuguugcgauugcaaguaacaauggggguaaacaggcacuugagacaguucaacguuuacugccuguacugugccaagcucacggucugacuccggaacaagucgucgcgauugcgaguaauaaugguggcaaacaagcauuagaaacggugcaacgccugcugccaguucuuugccaggcucacgguuuaaccccugagcagguuguagcuauugcgaguaacaauggugguaagcaggcguuggaaacugugcaaagacugcugcccguguugugccaagcacaugguuuaaccccagaacaagucguagcaaucgcaagcaauggggguggcaagcaagcgcuugaaacaguacagcguuuauuaccgguacuuugucaggcccacggucuuacaccagaacaaguuguggccauagccaguaauaauggcggaaagcaggcucuggaaacgguacaacgucuguuaccuguucugugucaagcgcacggauuaacaccugaacaaguaguugccauugcgucaaacauuggaggcaagcaggccuuggagacagugcagagauuacugccaguguugugucaggcucauggccuuacacccgagcaggucguggcaauugcaucucaugacggcgguaagcaagcuuuagagacuguucagagacugcuuccuguccugugccaggcacacggacuuacgccugagcaagugguugcaaucgccucuaauaucggugguaagcaagcacuggaaacuguccaacgcuuacuuccggugcuuugucaagcacacggcuuaacgccagagcaggucgucgccauagccagcaauauaggugguaaacaggcccuugaaacgguccaaagacuucugccgguccuuugccaagcgcaugggcugacaccugagcagguagucgcgauugccucaaacgguggugggaagcaggcauuagaaacaguucaaagauuauuaccaguccugugucaggcgcauggguuaaccccagagcagguaguugcaauagcauccaacaauggcggaaaacaagcguuggaaacgguucagcgguuauugccuguuuugugccaggcgcaugguuugacacccgagcaagugguagccauagccucaaauaauggggguaaacaagcuuuggagacaguacaacggcugcuuccaguuuuaugucaggcccauggauugacgccugaacaaguugucgcuaucgcaagucaugauggugguaaacaagcgcuugaaaccguucaacgccuucugccugugcuuugucaggcacauggauuaacacccgaacagguugucgcgauagcuucaaauggugguggucguccggcacuggaaagcauuguugcacagcugagccguccugauccggcacuggcagcacugaccaaugaucaucugguugcacuggcaugucuggguggucgcccugcccuggaugcaguuaaaaaaggucugccgcaugcaccggcacugauuaaacguaccaaucgucguauuccggaacguaccagccaucguguugcuagc

SEQ ID NO: 252 - RNA, 2406 nt, Artificial Sequence
  source: /note="Description of Artificial Sequence: Synthetic polynucleotide"
ggaucccauaugguugaucugcguacccuggguuauagccagcagcagcaagaaaaaaucaaaccgaaaguucguagcaccguugcacagcaucaugaagcacugguuggucaugguuuuacccaugcacauauuguugcacugagccagcauccggcagcacugggcaccguugcaguuaaauaucaggauaugauugcagcacugccggaagcaacccaugaagcaauuguugguguugguaaacgcggagcuggugcacgugcccuggaagcacugcugaccguugccggugaacugcgugguccgccucugcagcuggauaccggucagcugcugaaaauugcaaaacguggugguguuaccgcaguugaagcaguucaugcauggcguaaugcacugaccggugcaccgcugaaucugacaccggaacagguuguugcaauugccagcaauaaugguggcaaacaggcacuggaaaccguucagcgucugcugccgguucugugucaggcacauggucugaccccugaacaggugguggccauugcaagcaacauuggcgguaaacaagcccuggaaacagugcagcgccuguuaccggugcugugccaggcccauggcuuaacuccggaacaggugguagcgaucgcaucaaauaucggagguaaacaggccuuagaaaccguacagcgcuuacugccgguguuaugccaggcgcacggccugacgccagaacagguaguggcaaucgccucaaauggugguggaaaacaggcguuagagacaguccagcgccugcugccuguauuaugucaagcccauggccugaccccagagcaaguuguugcgauugcaaguaauggcggggguaaacaggcacuugagacaguucaacguuuacugccuguacugugccaagcucacggucugacuccggaacaagucgucgcgauugcgaguaauauagguggcaaacaagcauuagaaacggugcaacgccugcugccaguucuuugccaggcucacgguuuaaccccugagcagguuguagcuauugcgaguaacaauggugguaagcaggcguuggaaacugugcaaagacugcugcccguguugugccaagcacaugguuuaaccccagaacaagucguagcaaucgcaagcaauaaugguggcaagcaagcgcuugaaacaguacagcguuuauuaccgguacuuugucaggcccacggucuuacaccagaacaaguuguggccauagccaguaacaauggcggaaagcaggcucuggaaacgguacaacgucuguuaccuguucugugucaagcgcacggauuaacaccugaacaaguaguugccauugcgucaaauaauggaggcaagcaggccuuggagacagugcagagauuacugccaguguugugucaggcucauggccuuacacccgagcaggucguggcaauugcaucuaacauuggcgguaagcaagcuuuagagacuguucagagacugcuuccuguccugugccaggcacacggacuuacgccugagcaagugguugcaaucgccucuaaugggggugguaagcaagcacuggaaacuguccaacgcuuacuuccggugcuuugucaagcacacggcuuaacgccagagcaggucgucgccauagccagccaugauggugguaaacaggcccuugaaacgguccaaagacuucugccgguccuuugccaagcgcaugggcugacaccugagcagguagucgcgauugccucaaacgguggugggaagcaggcauuagaaacaguucaaagauuauuaccaguccugugucaggcgcauggguuaaccccagagcagguaguugcaauagcaucccaugacggcggaaaacaagcguuggaaacgguucagcgguuauugccuguuuugugccaggcgcaugguuugacacccgagcaagugguagccauagccucaaacaauggggguaaacaagcuuuggagacaguacaacggcugcuuccaguuuuaugucaggcccauggauugacgccugaacaaguugucgcuaucgcaaguaauaauggugguaaacaagcgcuugaaaccguucaacgccuucugccugugcuuugucaggcacauggauuaacacccgaacagguugucgcgauagcuucaaauaucgguggucguccggcacuggaaagcauuguugcacagcugagccguccugauccggcacuggcagcacugaccaaugaucaucugguugcacuggcaugucuggguggucgcccugcccuggaugcaguuaaaaaaggucugccgcaugcaccggcacugauuaaacguaccaaucgucguauuccggaacguaccagccaucguguugcuagc

SEQ ID NO: 253-299 - skipped (47 entries)

SEQ ID NO: 300 - RNA, 4101 nt, Artificial Sequence
  source: /note="Description of Artificial Sequence: Synthetic polynucleotide"
gacaagaaguacagcaucggccuggccaucggcaccaacagcgugggcugggccgugaucaccgacgaguacaaggugcccagcaagaaguucaaggugcugggcaacaccgaccggcacagcaucaagaagaaccugaucggcgcccugcuguucgacagcggcgagaccgccgaggccacccggcugaagcggaccgcccggcggcgguacacccggcggaagaaccggaucugcuaccugcaggagaucuucagcaacgagauggccaagguggacgacagcuucuuccaccggcuggaggagagcuuccugguggaggaggacaagaagcacgagcggcaccccaucuucggcaacaucguggacgagguggccuaccacgagaaguaccccaccaucuaccaccugcggaagaagcugguggacagcaccgacaaggccgaccugcggcugaucuaccuggcccuggcccacaugaucaaguuccggggccacuuccugaucgagggcgaccugaaccccgacaacagcgacguggacaagcuguucauccagcuggugcagaccuacaaccagcuguucgaggagaaccccaucaacgccagcggcguggacgccaaggccauccugagcgcccggcugagcaagagccggcggcuggagaaccugaucgcccagcugcccggcgagaagaagaacggccuguucggcaaccugaucgcccugagccugggccugacccccaacuucaagagcaacuucgaccuggccgaggacgccaagcugcagcugagcaaggacaccuacgacgacgaccuggacaaccugcuggcccagaucggcgaccaguacgccgaccuguuccuggccgccaagaaccugagcgacgccauccugcugagcgacauccugcgggugaacaccgagaucaccaaggccccccugagcgccagcaugaucaagcgguacgacgagcaccaccaggaccugacccugcugaaggcccuggugcggcagcagcugcccgagaaguacaaggagaucuucuucgaccagagcaagaacggcuacgccggcuacaucgacggcggcgccagccaggaggaguucuacaaguucaucaagcccauccuggagaagauggacggcaccgaggagcugcuggugaagcugaaccgggaggaccugcugcggaagcagcggaccuucgacaacggcagcaucccccaccagauccaccugggcgagcugcacgccauccugcggcggcaggaggacuucuaccccuuccugaaggacaaccgggagaagaucgagaagauccugaccuuccggauccccuacuacgugggcccccuggcccggggcaacagccgguucgccuggaugacccggaaauccgaggagaccaucacccccuggaacuucgaggaggugguggacaagggcgccagcgcccagagcuucaucgagcggaugaccaacuucgacaagaaccugcccaacgagaaggugcugcccaagcacagccugcuguacgaguacuucaccguguacaacgagcugaccaaggugaaguacgugaccgagggcaugcggaagcccgccuuccugagcggcgagcagaagaaggccaucguggaccugcuguucaagaccaaccggaaggugaccgugaagcagcugaaggaggacuacuucaagaagaucgagugcuucgacagcguggagaucagcggcguggaggaccgguucaacgccagccugggcaccuaccacgaccugcugaagaucaucaaggacaaggacuuccuggacaacgaggagaacgaggacauccuggaggacaucgugcugacccugacccuguucgaggaccgggagaugaucgaggagcggcugaaaaccuacgcccaccuguucgacgacaaggugaugaagcagcugaagcggcggcgguacaccggcuggggccggcugagccggaagcugaucaacggcauccgggacaagcagagcggcaagaccauccuggacuuccugaaauccgacggcuucgccaaccggaacuucaugcagcugauccacgacgacagccugaccuucaaggaggacauccagaaggcccaggugagcggccagggcgacagccugcacgagcacaucgccaaccuggccggcagccccgccaucaagaagggcauccugcagaccgugaaggugguggacgagcuggugaaggugaugggccggcacaagcccgagaacaucgugaucgagauggcccgggagaaccagaccacccagaagggccagaagaacagccgggagcggaugaagcggaucgaggagggcaucaaggagcugggcagccagauccugaaggagcaccccguggagaacacccagcugcagaacgagaagcuguaccuguacuaccugcagaacggccgggacauguacguggaccaggagcuggacaucaaccggcugagcgacuacgacguggccgccaucgugccccagagcuuccugaaggacgacagcaucgacaacaaggugcugacccggagcgacaaggcccggggcaagagcgacaacgugcccagcgaggagguggugaagaagaugaagaacuacuggcggcagcugcugaacgccaagcugaucacccagcggaaguucgacaaccugaccaaggccgagcggggcggccugagcgagcuggacaaggccggcuucaucaagcggcagcugguggagacccggcagaucaccaagcacguggcccagauccuggacagccggaugaacaccaaguacgacgagaacgacaagcugauccgggaggugaaggugaucacccugaaauccaagcuggugagcgacuuccggaaggacuuccaguucuacaaggugcgggagaucaacaacuaccaccacgcccacgacgccuaccugaacgccguggugggcaccgcccugaucaagaaguaccccaagcuggagagcgaguucguguacggcgacuacaagguguacgacgugcggaagaugaucgccaagagcgagcaggagaucggcaaggccaccgccaaguacuucuucuacagcaacaucaugaacuucuucaagaccgagaucacccuggccaacggcgagauccggaagcggccccugaucgagaccaacggcgagaccggcgagaucgugugggacaagggccgggacuucgccaccgugcggaaggugcugagcaugccccaggugaacaucgugaagaaaaccgaggugcagaccggcggcuucagcaaggagagcauccugcccaagcggaacagcgacaagcugaucgcccggaagaaggacugggaccccaagaaguacggcggcuucgacagccccaccguggccuacagcgugcuggugguggccaagguggagaagggcaagagcaagaagcugaaauccgugaaggagcugcugggcaucaccaucauggagcggagcagcuucgagaagaaccccaucgacuuccuggaggccaagggcuacaaggaggugaagaaggaccugaucaucaagcugcccaaguacagccuguucgagcuggagaacggccggaagcggaugcuggccagcgccggcgagcugcagaagggcaacgagcuggcccugcccagcaaguacgugaacuuccuguaccuggccagccacuacgagaagcugaagggcagccccgaggacaacgagcagaagcagcuguucguggagcagcacaagcacuaccuggacgagaucaucgagcagaucagcgaguucagcaagcgggugauccuggccgacgccaaccuggacaaggugcugagcgccuacaacaagcaccgggacaagcccauccgggagcaggccgagaacaucauccaccuguucacccugaccaaccugggcgcccccgccgccuucaaguacuucgacaccaccaucgaccggaagcgguacaccagcaccaaggaggugcuggacgccacccugauccaccagagcaucaccggccuguacgagacccggaucgaccugagccagcugggcggcgac

SEQ ID NO: 301 - protein, 789 aa, Artificial Sequence; identical to SEQ ID NO: 116
  source: /note="Description of Artificial Sequence: Synthetic polypeptide"

SEQ ID NO: 302 - protein, 789 aa, Artificial Sequence; identical to SEQ ID NO: 124
  source: /note="Description of Artificial Sequence: Synthetic polypeptide"

SEQ ID NO: 303 - protein, 789 aa, Artificial Sequence; identical to SEQ ID NO: 136
  source: /note="Description of Artificial Sequence: Synthetic polypeptide"

SEQ ID NO: 304 - protein, 789 aa, Artificial Sequence; identical to SEQ ID NO: 152
  source: /note="Description of Artificial Sequence: Synthetic polypeptide"

SEQ ID NO: 305 - protein, 789 aa, Artificial Sequence; identical to SEQ ID NO: 156
  source: /note="Description of Artificial Sequence: Synthetic polypeptide"

SEQ ID NO: 306 - protein, 1614 aa, Artificial Sequence; identical to SEQ ID NO: 176
  source: /note="Description of Artificial Sequence: Synthetic polypeptide"

SEQ ID NO: 307 - protein, 1714 aa, Artificial Sequence
  source: /note="Description of Artificial Sequence: Synthetic polypeptide"
MAPKKKRKVGIHGVPAAGSSGSSGSLEPGEKPYKCPECGKSFSTSGNLTEHQRTHTGEKPYKCPECGKSFSDSGNLRVHQRTHTGEKPYKCPECGKSFSHKNALQNHQRTHTGEKPYKCPECGKSFSRNDTLTEHQRTHTGEKPYKCPECGKSFSQRAHLERHQRTHTGEKPYKCPECGKSFSRSDKLVRHQRTHTGEKPYKCPECGKSFSDPGHLVRHQRTHTGEKPTGKKTSASGSGGGSGGDALDDFDLDMLGSDALDDFDLDMLGSDALDDFDLDMLGSDALDDFDLDMLSGGPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAFPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRLRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLFSGGKRPAATKKAGQAKKKKGSYPYDVPDYAATNFSLLKQAGDVEENPGPTSAGKLGSGEGRGSLLTCGDVEENPGPLEGSSGSGSLEPGEKPYKCPECGKSFSRSDHLTNHQRTHTGEKPYKCPECGKSFSTSGSLVRHQRTHTGEKPYKCPECGKSFSQAGHLASHQRTHTGEKPYKCPECGKSFSRSDKLTEHQRTHTGEKPYKCPECGKSFSTSGNLTEHQRTHTGEKPYKCPECGKSFSQSSNLVRHQRTHTGEKPYKCPECGKSFSTHLDLIRHQRTHTGEKPTGKKTSASGSGGGSGGIFKPEELRQALMPTLEALYRQDPESLPFRQPVDPQLLGIPDYFDIVKSPMDLSTIKRKLDTGQYQEPWQYVDDIWLMFNNAWLYNRKTSRVYKYCSKLSEVFEQEIDPVMQSLGYCCGRKLEFSPQTLCCYGKQLCTIPRDATYYSYQNRYHFCEKCFNEIQGESVSLGDDPSQPQTTINKEQFSKRKNDTLDPELFVECTECGRKMHQICVLHHEIIWPAGFVCDGCLKKSARTRKENKFSAKRLPSTRLGTFLENRVNDFLRRQNHPESGEVTVRVVHASDKTVEVKPGMKARFVDSGEMAESFPYRTKALFAFEEIDGVDLCFFGMHVQEYGSDCPPPNQRRVYISYLDSVHFFRPKCLRTAVYHEILIGYLEYVKKLGYTTGHIWACPPSEGDDYIFHCHPPDQKIPKPKRLQEWYKKMLDKAVSERIVHDYKDIFKQATEDRLTSAKELPYFEGDFWPNVLEESIKELEQEEEERKREENTSNESTDVTKGDSKNAKKKNNKKTSKNKSSLSRGNKKKPGMPNVSNDLSQKLYATMEKHKEVFFVIRLIAGPAANSLPPIVDPDPLIPCDLMDGRDAFLTLARDKHLEFSSLRRAQWSTMCMLVELHTQSQDSGGKRPAATKKAGQAKKKKGSYPYDVPDYA

SEQ ID NO: 308 - protein, 1708 aa, Artificial Sequence; identical to SEQ ID NO: 182
  source: /note="Description of Artificial Sequence: Synthetic polypeptide"

SEQ ID NO: 309 - protein, 7 aa, Artificial Sequence
  source: /note="Description of Artificial Sequence: Synthetic peptide"
LEPGEKP

SEQ ID NO: 310 - protein, 6 aa, Artificial Sequence
  source: /note="Description of Artificial Sequence: Synthetic peptide"
TGKKTS

SEQ ID NO: 311 - protein, 12 aa, Artificial Sequence
  source: /note="Description of Artificial Sequence: Synthetic peptide"
THPRAPIPKPFQ

SEQ ID NO: 312 - protein, 16 aa, Artificial Sequence
  source: /note="Description of Artificial Sequence: Synthetic peptide"
TPNPHRRTDPSHKPFQ

SEQ ID NO: 313 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDNLVRHXXXHXXXXXXXCXXCXXXXXRSDHLTNHXXXHXXXXXXXCXXCXXXXXDPGHLVRHXXXHXXXXXXXCXXCXXXXXQRAHLERHXXXHXXXXXXXCXXCXXXXXSRRTCRAHXXXHXXXXXXXCXXCXXXXXRSDKLTEHXXXHXXXXXXXCXXCXXXXXRNDTLTEHXXXHXXXXXXXXXXX

SEQ ID NO: 314 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSSNLVRHXXXHXXXXXXXCXXCXXXXXSKKHLAEHXXXHXXXXXXXCXXCXXXXXSKKALTEHXXXHXXXXXXXCXXCXXXXXDCRDLARHXXXHXXXXXXXCXXCXXXXXDPGHLVRHXXXHXXXXXXXCXXCXXXXXRNDALTEHXXXHXXXXXXXCXXCXXXXXDKKDLTRHXXXHXXXXXXXXXXX

SEQ ID NO: 315 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDNLVRHXXXHXXXXXXXCXXCXXXXXQLAHLRAHXXXHXXXXXXXCXXCXXXXXDPGHLVRHXXXHXXXXXXXCXXCXXXXXQSSNLVRHXXXHXXXXXXXCXXCXXXXXRKDNLKNHXXXHXXXXXXXCXXCXXXXXQAGHLASHXXXHXXXXXXXCXXCXXXXXTSGSLVRHXXXHXXXXXXXXXXX

SEQ ID NO: 316 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQRAHLERHXXXHXXXXXXXCXXCXXXXXQLAHLRAHXXXHXXXXXXXCXXCXXXXXSKKHLAEHXXXHXXXXXXXCXXCXXXXXTTGALTEHXXXHXXXXXXXCXXCXXXXXTSGNLVRHXXXHXXXXXXXCXXCXXXXXQSGDLRRHXXXHXXXXXXXCXXCXXXXXTSHSLTEHXXXHXXXXXXXXXXX

SEQ ID NO: 317 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGNLTEHXXXHXXXXXXXCXXCXXXXXDSGNLRVHXXXHXXXXXXXCXXCXXXXXHKNALQNHXXXHXXXXXXXCXXCXXXXXRNDTLTEHXXXHXXXXXXXCXXCXXXXXQRAHLERHXXXHXXXXXXXCXXCXXXXXRSDKLVRHXXXHXXXXXXXCXXCXXXXXDPGHLVRHXXXHXXXXXXXXXXX

SEQ ID NO: 318 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSHSLTEHXXXHXXXXXXXCXXCXXXXXQRANLRAHXXXHXXXXXXXCXXCXXXXXRADNLTEHXXXHXXXXXXXCXXCXXXXXERSHLREHXXXHXXXXXXXCXXCXXXXXDPGALVRHXXXHXXXXXXXCXXCXXXXXTSGHLVRHXXXHXXXXXXXCXXCXXXXXRNDTLTEHXXXHXXXXXXXXXXX

SEQ ID NO: 319 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTNHXXXHXXXXXXXCXXCXXXXXTSGSLVRHXXXHXXXXXXXCXXCXXXXXQAGHLASHXXXHXXXXXXXCXXCXXXXXRSDKLTEHXXXHXXXXXXXCXXCXXXXXTSGNLTEHXXXHXXXXXXXCXXCXXXXXQSSNLVRHXXXHXXXXXXXCXXCXXXXXTHLDLIRHXXXHXXXXXXXXXXX

SEQ ID NO: 320 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTTHXXXHXXXXXXXCXXCXXXXXTSGELVRHXXXHXXXXXXXCXXCXXXXXRRDELNVHXXXHXXXXXXXCXXCXXXXXSPADLTRHXXXHXXXXXXXCXXCXXXXXRSDELVRHXXXHXXXXXXXCXXCXXXXXRSDKLVRHXXXHXXXXXXXCXXCXXXXXTTGALTEHXXXHXXXXXXXXXXX

SEQ ID NO: 321 - protein, 220 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(188): Any amino acid
  MOD_RES (190)..(191): Any amino acid
  MOD_RES (193)..(197): Any amino acid
  MOD_RES (206)..(208): Any amino acid
  MOD_RES (210)..(220): Any amino acid
XXXXXXXXXCXXCXXXXXQSGNLTEHXXXHXXXXXXXCXXCXXXXXHKNALQNHXXXHXXXXXXXCXXCXXXXXQNSTLTEHXXXHXXXXXXXCXXCXXXXXSKKHLAEHXXXHXXXXXXXCXXCXXXXXTSGNLVRHXXXHXXXXXXXCXXCXXXXXQSGHLTEHXXXHXXXXXXXXXXXXXXXXXXCXXCXXXXXDKKDLTRHXXXHXXXXXXXXXXX

SEQ ID NO: 322 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQNSTLTEHXXXHXXXXXXXCXXCXXXXXERSHLREHXXXHXXXXXXXCXXCXXXXXSKKHLAEHXXXHXXXXXXXCXXCXXXXXRNDTLTEHXXXHXXXXXXXCXXCXXXXXDCRDLARHXXXHXXXXXXXCXXCXXXXXQSGDLRRHXXXHXXXXXXXCXXCXXXXXTKNSLTEHXXXHXXXXXXXXXXX

SEQ ID NO: 323 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXERSHLREHXXXHXXXXXXXCXXCXXXXXRADNLTEHXXXHXXXXXXXCXXCXXXXXRSDKLTEHXXXHXXXXXXXCXXCXXXXXSKKHLAEHXXXHXXXXXXXCXXCXXXXXTKNSLTEHXXXHXXXXXXXCXXCXXXXXDKKDLTRHXXXHXXXXXXXCXXCXXXXXSKKHLAEHXXXHXXXXXXXXXXX

SEQ ID NO: 324 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKHLAEHXXXHXXXXXXXCXXCXXXXXTHLDLIRHXXXHXXXXXXXCXXCXXXXXRKDNLKNHXXXHXXXXXXXCXXCXXXXXDCRDLARHXXXHXXXXXXXCXXCXXXXXREDNLHTHXXXHXXXXXXXCXXCXXXXXDPGHLVRHXXXHXXXXXXXCXXCXXXXXQLAHLRAHXXXHXXXXXXXXXXX

SEQ ID NO: 325 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXQSGDLRRHXXXHXXXXXXXCXXCXXXXXTSGELVRHXXXHXXXXXXXCXXCXXXXXRSDKLVRHXXXHXXXXXXXCXXCXXXXXDPGHLVRHXXXHXXXXXXXCXXCXXXXXRNDALTEHXXXHXXXXXXXCXXCXXXXXRSDHLTNHXXXHXXXXXXXXXXX

SEQ ID NO: 326 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGHLVRHXXXHXXXXXXXCXXCXXXXXTTGNLTVHXXXHXXXXXXXCXXCXXXXXTSGSLVRHXXXHXXXXXXXCXXCXXXXXRSDKLVRHXXXHXXXXXXXCXXCXXXXXRSDELVRHXXXHXXXXXXXCXXCXXXXXRSDKLVRHXXXHXXXXXXXCXXCXXXXXQRAHLERHXXXHXXXXXXXXXXX

SEQ ID NO: 327 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRNDTLTEHXXXHXXXXXXXCXXCXXXXXRNDALTEHXXXHXXXXXXXCXXCXXXXXTSGELVRHXXXHXXXXXXXCXXCXXXXXRSDNLVRHXXXHXXXXXXXCXXCXXXXXRSDELVRHXXXHXXXXXXXCXXCXXXXXRSDKLVRHXXXHXXXXXXXCXXCXXXXXQSSNLVRHXXXHXXXXXXXXXXX

SEQ ID NO: 328 - protein, 11 aa, Herpes simplex virus
DALDDFDLDML

SEQ ID NO: 329 - DNA, 20 bp, Artificial Sequence
  source: /note="Description of Artificial Sequence: Synthetic oligonucleotide"
atgcccccagctctccggct

SEQ ID NO: 330 - DNA, 20 bp, Artificial Sequence
  source: /note="Description of Artificial Sequence: Synthetic oligonucleotide"
cagcgtgaacgcgcccctcg

SEQ ID NO: 331 - DNA, 20 bp, Artificial Sequence
  source: /note="Description of Artificial Sequence: Synthetic oligonucleotide"
cttacggtaagtggggctgg

SEQ ID NO: 332 - DNA, 20 bp, Artificial Sequence
  source: /note="Description of Artificial Sequence: Synthetic oligonucleotide"
cccgtaagaaacacacgggg

SEQ ID NO: 333 - DNA, 20 bp, Artificial Sequence
  source: /note="Description of Artificial Sequence: Synthetic oligonucleotide"
attgaattaggggatctcgg

SEQ ID NO: 334 - DNA, 20 bp, Artificial Sequence
  source: /note="Description of Artificial Sequence: Synthetic oligonucleotide"
gacttggggtgacaatggct

SEQ ID NO: 335 - DNA, 20 bp, Artificial Sequence
  source: /note="Description of Artificial Sequence: Synthetic oligonucleotide"
agccggagagctgggggcat

SEQ ID NO: 336 - DNA, 20 bp, Artificial Sequence
  source: /note="Description of Artificial Sequence: Synthetic oligonucleotide"
cgaggggcgcgttcacgctg

SEQ ID NO: 337 - DNA, 20 bp, Artificial Sequence
  source: /note="Description of Artificial Sequence: Synthetic oligonucleotide"
ccagccccacttaccgtaag

SEQ ID NO: 338 - DNA, 20 bp, Artificial Sequence
  source: /note="Description of Artificial Sequence: Synthetic oligonucleotide"
ccccgtgtgtttcttacggg

SEQ ID NO: 339 - DNA, 20 bp, Artificial Sequence
  source: /note="Description of Artificial Sequence: Synthetic oligonucleotide"
ccgagatcccctaattcaat

SEQ ID NO: 340 - DNA, 20 bp, Artificial Sequence
  source: /note="Description of Artificial Sequence: Synthetic oligonucleotide"
agccattgtcaccccaagtc

SEQ ID NO: 341 - RNA, 47 nt, Artificial Sequence
  source: /note="Description of Artificial Sequence: Synthetic oligonucleotide"
aggaaauaagagagaaaagaagaguaagaagaaauauaagagccacc

SEQ ID NO: 342 - RNA, 57 nt, Artificial Sequence
  source: /note="Description of Artificial Sequence: Synthetic oligonucleotide"
cucucccuugcaccuguaccucuuggucuuugaauaaagccugaguaggaagucuag

SEQ ID NO: 343 - RNA, 78 nt, Artificial Sequence
  source: /note="Description of Artificial Sequence: Synthetic oligonucleotide"
aaaaaaaaaaaaaaaaaaaaaaaaaaaaaaaaaaaaaaaaaaaaaaaaaaaaaaaaaaaaaaaaaaaaaaaaaaaaaa

SEQ ID NO: 344 - DNA, 20 bp, Homo sapiens
ccctcacccccaccccctcc

SEQ ID NO: 345 - DNA, 20 bp, Homo sapiens
tccgggagggggtgggggtg

SEQ ID NO: 346 - DNA, 20 bp, Homo sapiens
ccgggagggggtgggggtga

SEQ ID NO: 347 - DNA, 20 bp, Homo sapiens
ggggtgggggtgagggaaac

SEQ ID NO: 348 - DNA, 20 bp, Homo sapiens
agggaaacaggagaatgtga

SEQ ID NO: 349 - DNA, 20 bp, Homo sapiens
gggaaacaggagaatgtgat

SEQ ID NO: 350 - DNA, 20 bp, Homo sapiens
tgtgatgggaaaatccgaga

SEQ ID NO: 351 - DNA, 20 bp, Homo sapiens
ggcccaggctggctccatct

SEQ ID NO: 352 - DNA, 20 bp, Homo sapiens
aatccgagatggagccagcc

SEQ ID NO: 353 - DNA, 20 bp, Homo sapiens
atccgagatggagccagcct

SEQ ID NO: 354 - DNA, 20 bp, Homo sapiens
ccagtgtttctggcccaggc

SEQ ID NO: 355 - DNA, 20 bp, Homo sapiens
gctcccagtgtttctggccc

SEQ ID NO: 356 - DNA, 20 bp, Homo sapiens
cccacagctcccagtgtttc

SEQ ID NO: 357 - DNA, 20 bp, Homo sapiens
ccagcctgggccagaaacac

SEQ ID NO: 358 - DNA, 20 bp, Homo sapiens
cagcctgggccagaaacact

SEQ ID NO: 359 - DNA, 20 bp, Homo sapiens
gccagaaacactgggagctg

SEQ ID NO: 360 - DNA, 20 bp, Homo sapiens
ccagaaacactgggagctgt

SEQ ID NO: 361 - DNA, 20 bp, Homo sapiens
acactgggagctgtgggaga

SEQ ID NO: 362 - DNA, 20 bp, Homo sapiens
gggagctgtgggagacggag

SEQ ID NO: 363 - DNA, 20 bp, Homo sapiens
ggagctgtgggagacggaga

SEQ ID NO: 364 - DNA, 20 bp, Homo sapiens
gagctgtgggagacggagag

SEQ ID NO: 365 - DNA, 20 bp, Homo sapiens
tgtgggagacggagaggggc

SEQ ID NO: 366 - DNA, 20 bp, Homo sapiens
gtgggagacggagaggggca

SEQ ID NO: 367 - DNA, 20 bp, Homo sapiens
ggagacggagaggggcaggg

SEQ ID NO: 368 - DNA, 20 bp, Homo sapiens
gagacggagaggggcagggt

SEQ ID NO: 369 - DNA, 20 bp, Homo sapiens
gaggggcagggtgggatcac

SEQ ID NO: 370 - DNA, 20 bp, Homo sapiens
aggggcagggtgggatcaca

SEQ ID NO: 371 - DNA, 20 bp, Homo sapiens
agggtgggatcacagggagc

SEQ ID NO: 372 - DNA, 20 bp, Homo sapiens
gggatcacagggagcaggag

SEQ ID NO: 373 - DNA, 20 bp, Homo sapiens
ggatcacagggagcaggagc

SEQ ID NO: 374 - DNA, 20 bp, Homo sapiens
gatcacagggagcaggagcg

SEQ ID NO: 375 - DNA, 20 bp, Homo sapiens
agggagcaggagcggggaat

SEQ ID NO: 376 - DNA, 20 bp, Homo sapiens
gagcaggagcggggaattgg

SEQ ID NO: 377 - DNA, 20 bp, Homo sapiens
cggggaattggaggtgaatc

SEQ ID NO: 378 - DNA, 20 bp, Homo sapiens
aatggactggaagtttggga

SEQ ID NO: 379 - DNA, 20 bp, Homo sapiens
gaatggactggaagtttggg

SEQ ID NO: 380 - DNA, 20 bp, Homo sapiens
gcagaatggactggaagttt

SEQ ID NO: 381 - DNA, 20 bp, Homo sapiens
agcagaatggactggaagtt

SEQ ID NO: 382 - DNA, 20 bp, Homo sapiens
cccctgggagcagaatggac

SEQ ID NO: 383 - DNA, 20 bp, Homo sapiens
cggttcccctgggagcagaa

SEQ ID NO: 384 - DNA, 20 bp, Homo sapiens
ttccagtccattctgctccc

SEQ ID NO: 385 - DNA, 20 bp, Homo sapiens
tccagtccattctgctccca

SEQ ID NO: 386 - DNA, 20 bp, Homo sapiens
ccagtccattctgctcccag

SEQ ID NO: 387 - DNA, 20 bp, Homo sapiens
cgcagtttcccggttcccct

SEQ ID NO: 388 - DNA, 20 bp, Homo sapiens
ccgcagtttcccggttcccc

SEQ ID NO: 389 - DNA, 20 bp, Homo sapiens
cattctgctcccaggggaac

SEQ ID NO: 390 - DNA, 20 bp, Homo sapiens
attctgctcccaggggaacc

SEQ ID NO: 391 - DNA, 20 bp, Homo sapiens
ccagttcccccgcagtttcc

SEQ ID NO: 392 - DNA, 20 bp, Homo sapiens
ccaggggaaccgggaaactg

SEQ ID NO: 393 - DNA, 20 bp, Homo sapiens
caggggaaccgggaaactgc

SEQ ID NO: 394 - DNA, 20 bp, Homo sapiens
aggggaaccgggaaactgcg

SEQ ID NO: 395 - DNA, 20 bp, Homo sapiens
ggggaaccgggaaactgcgg

SEQ ID NO: 396 - DNA, 20 bp, Homo sapiens
ccgggaaactgcgggggaac

SEQ ID NO: 397 - DNA, 20 bp, Homo sapiens
gaaactgcgggggaactgga

SEQ ID NO: 398 - DNA, 20 bp, Homo sapiens
aaactgcgggggaactggaa

SEQ ID NO: 399 - DNA, 20 bp, Homo sapiens
ggaagggagctcccagaaca

SEQ ID NO: 400 - DNA, 20 bp, Homo sapiens
atcttctggatccttgttct

SEQ ID NO: 401 - DNA, 20 bp, Homo sapiens
aatcttctggatccttgttc

SEQ ID NO: 402 - DNA, 20 bp, Homo sapiens
agaacaaggatccagaagat

SEQ ID NO: 403 - DNA, 20 bp, Homo sapiens
ggccccagatgccaatcttc

SEQ ID NO: 404 - DNA, 20 bp, Homo sapiens
ggatccagaagattggcatc

SEQ ID NO: 405 - DNA, 20 bp, Homo sapiens
gatccagaagattggcatct

SEQ ID NO: 406 - DNA, 20 bp, Homo sapiens
atccagaagattggcatctg

SEQ ID NO: 407 - DNA, 20 bp, Homo sapiens
gaagattggcatctggggcc

SEQ ID NO: 408 - DNA, 20 bp, Homo sapiens
aagattggcatctggggcct

SEQ ID NO: 409 - DNA, 20 bp, Homo sapiens
gatttagaaacctaaatccc

SEQ ID NO: 410 - DNA, 20 bp, Homo sapiens
gcatctggggcctgggattt

SEQ ID NO: 411 - DNA, 20 bp, Homo sapiens
ggatttaggtttctaaatcg

SEQ ID NO: 412 - DNA, 20 bp, Homo sapiens
gatttaggtttctaaatcgt

SEQ ID NO: 413 - DNA, 20 bp, Homo sapiens
ggtttctaaatcgtgggcca

SEQ ID NO: 414 - DNA, 20 bp, Homo sapiens
gtttctaaatcgtgggccat

SEQ ID NO: 415 - DNA, 20 bp, Homo sapiens
tttctaaatcgtgggccatg

SEQ ID NO: 416 - DNA, 20 bp, Homo sapiens
gcagagataaggctgcccca

SEQ ID NO: 417 - DNA, 20 bp, Homo sapiens
tcaatgcttttgcagagata

SEQ ID NO: 418 - DNA, 20 bp, Homo sapiens
ttatctctgcaaaagcattg

SEQ ID NO: 419 - DNA, 20 bp, Homo sapiens
tatctctgcaaaagcattga

SEQ ID NO: 420 - DNA, 20 bp, Homo sapiens
gagggtagaagtcaatgatt

SEQ ID NO: 421 - DNA, 20 bp, Homo sapiens
agggtagaagtcaatgattt

SEQ ID NO: 422 - DNA, 20 bp, Homo sapiens
atttgggaagttattgaatt

SEQ ID NO: 423 - DNA, 20 bp, Homo sapiens
tttgggaagttattgaatta

SEQ ID NO: 424 - DNA, 20 bp, Homo sapiens
ttgggaagttattgaattag

SEQ ID NO: 425 - DNA, 20 bp, Homo sapiens
gttattgaattaggggatct

SEQ ID NO: 426 - DNA, 20 bp, Homo sapiens
aattaggggatctcggaggt

SEQ ID NO: 427 - DNA, 20 bp, Homo sapiens
gcattctaactgatactatc

SEQ ID NO: 428 - DNA, 20 bp, Homo sapiens
atcagttagaatgcctgact

SEQ ID NO: 429 - DNA, 20 bp, Homo sapiens
tcagttagaatgcctgactt

SEQ ID NO: 430 - DNA, 20 bp, Homo sapiens
cagttagaatgcctgacttg

SEQ ID NO: 431 - DNA, 20 bp, Homo sapiens
tgcctgacttggggtgacaa

SEQ ID NO: 432 - DNA, 20 bp, Homo sapiens
ttggggtgacaatggcttgg

SEQ ID NO: 433 - DNA, 20 bp, Homo sapiens
tggggtgacaatggcttgga

SEQ ID NO: 434 - DNA, 20 bp, Homo sapiens
ggggtgacaatggcttggag

SEQ ID NO: 435 - DNA, 20 bp, Homo sapiens
gtgacaatggcttggagggg

SEQ ID NO: 436 - DNA, 20 bp, Homo sapiens
tgacaatggcttggaggggt

SEQ ID NO: 437 - DNA, 20 bp, Homo sapiens
ttggaggggtgggtgagtca

SEQ ID NO: 438 - DNA, 20 bp, Homo sapiens
tggaggggtgggtgagtcaa

SEQ ID NO: 439 - DNA, 20 bp, Homo sapiens
aggcaggcatcatgactcac

SEQ ID NO: 440 - DNA, 20 bp, Homo sapiens
aaggcaggcatcatgactca

SEQ ID NO: 441 - DNA, 20 bp, Homo sapiens
agttatcaattgtacaaggc

SEQ ID NO: 442 - DNA, 20 bp, Homo sapiens
gttcagttatcaattgtaca

SEQ ID NO: 443 - DNA, 20 bp, Homo sapiens
tacaattgataactgaacat

SEQ ID NO: 444 - DNA, 20 bp, Homo sapiens
taactgaacatcggtgagtt

SEQ ID NO: 445 - DNA, 20 bp, Homo sapiens
ggtgctaattacaactgctg

SEQ ID NO: 446 - DNA, 20 bp, Homo sapiens
gggtgctaattacaactgct

SEQ ID NO: 447 - DNA, 20 bp, Homo sapiens
ggggtgctaattacaactgc

SEQ ID NO: 448 - DNA, 20 bp, Homo sapiens
agcagttgtaattagcaccc

SEQ ID NO: 449 - DNA, 20 bp, Homo sapiens
gcagttgtaattagcacccc

SEQ ID NO: 450 - DNA, 20 bp, Homo sapiens
ttggtttctggctgacaccc

SEQ ID NO: 451 - DNA, 20 bp, Homo sapiens
gttggtttctggctgacacc

SEQ ID NO: 452 - DNA, 20 bp, Homo sapiens
tttggctgtttgttggtttc

SEQ ID NO: 453 - DNA, 20 bp, Homo sapiens
gcagggatttggctgtttgt

SEQ ID NO: 454 - DNA, 20 bp, Homo sapiens
tgggcggggctgcagggatt

SEQ ID NO: 455 - DNA, 20 bp, Homo sapiens
ataggctgggcggggctgca

SEQ ID NO: 456 - DNA, 20 bp, Homo sapiens
gataggctgggcggggctgc

SEQ ID NO: 457 - DNA, 20 bp, Homo sapiens
gccggtggataggctgggcg

SEQ ID NO: 458 - DNA, 20 bp, Homo sapiens
cgccggtggataggctgggc

SEQ ID NO: 459 - DNA, 20 bp, Homo sapiens
ccgccggtggataggctggg

SEQ ID NO: 460 - DNA, 20 bp, Homo sapiens
cccccgccggtggataggct

SEQ ID NO: 461 - DNA, 20 bp, Homo sapiens
tcccccgccggtggataggc

SEQ ID NO: 462 - DNA, 20 bp, Homo sapiens
gccccgcccagcctatccac

SEQ ID NO: 463 - DNA, 20 bp, Homo sapiens
tcggtcccccgccggtggat

SEQ ID NO: 464 - DNA, 20 bp, Homo sapiens
ccgcccagcctatccaccgg

SEQ ID NO: 465 - DNA, 20 bp, Homo sapiens
cgcccagcctatccaccggc

SEQ ID NO: 466 - DNA, 20 bp, Homo sapiens
gcccagcctatccaccggcg

SEQ ID NO: 467 - DNA, 20 bp, Homo sapiens
gttaatcggtcccccgccgg

SEQ ID NO: 468 - DNA, 20 bp, Homo sapiens
cccagcctatccaccggcgg

SEQ ID NO: 469 - DNA, 20 bp, Homo sapiens
ggtgggggttaatggttaat

SEQ ID NO: 470 - DNA, 20 bp, Homo sapiens
cggggaggggtgggggttaa

SEQ ID NO: 471 - DNA, 20 bp, Homo sapiens
gctctgccggggaggggtgg

SEQ ID NO: 472 - DNA, 20 bp, Homo sapiens
ggctctgccggggaggggtg

SEQ ID NO: 473 - DNA, 20 bp, Homo sapiens
aggctctgccggggaggggt

SEQ ID NO: 474 - DNA, 20 bp, Homo sapiens
gaggctctgccggggagggg

SEQ ID NO: 475 - DNA, 20 bp, Homo sapiens
cattaacccccacccctccc

SEQ ID NO: 476 - DNA, 20 bp, Homo sapiens
gtggaggctctgccggggag

SEQ ID NO: 477 - DNA, 20 bp, Homo sapiens
ggtggaggctctgccgggga

SEQ ID NO: 478 - DNA, 20 bp, Homo sapiens
gggtggaggctctgccgggg

SEQ ID NO: 479 - DNA, 20 bp, Homo sapiens
aaggggtggaggctctgccg

SEQ ID NO: 480 - DNA, 20 bp, Homo sapiens
gaaggggtggaggctctgcc

SEQ ID NO: 481 - DNA, 20 bp, Homo sapiens
tgaaggggtggaggctctgc

SEQ ID NO: 482 - DNA, 20 bp, Homo sapiens
tagcctctgtgaaggggtgg

SEQ ID NO: 483 - DNA, 20 bp, Homo sapiens
gcctagcctctgtgaagggg

SEQ ID NO: 484 - DNA, 20 bp, Homo sapiens
ttggcctagcctctgtgaag

SEQ ID NO: 485 - DNA, 20 bp, Homo sapiens
cttggcctagcctctgtgaa

SEQ ID NO: 486 - DNA, 20 bp, Homo sapiens
gagcctccaccccttcacag

SEQ ID NO: 487 - DNA, 20 bp, Homo sapiens
tcttggcctagcctctgtga

SEQ ID NO: 488 - DNA, 20 bp, Homo sapiens
tccaccccttcacagaggct

SEQ ID NO: 489 - DNA, 20 bp, Homo sapiens
ggaagatctgctgggagtct

SEQ ID NO: 490 - DNA, 20 bp, Homo sapiens
cgtcctctgggaagatctgc

SEQ ID NO: 491 - DNA, 20 bp, Homo sapiens
ctcccagcagatcttcccag

SEQ ID NO: 492 - DNA, 20 bp, Homo sapiens
cagcagatcttcccagagga

SEQ ID NO: 493 - DNA, 20 bp, Homo sapiens
ttcctttcaaaccgtcctct

SEQ ID NO: 494 - DNA, 20 bp, Homo sapiens
cttcctttcaaaccgtcctc

SEQ ID NO: 495 - DNA, 20 bp, Homo sapiens
ttcccagaggacggtttgaa

SEQ ID NO: 496 - DNA, 20 bp, Homo sapiens
cagaggacggtttgaaagga

SEQ ID NO: 497 - DNA, 20 bp, Homo sapiens
gtttgaaaggaaggcagaga

SEQ ID NO: 498 - DNA, 20 bp, Homo sapiens
aaggaaggcagagagggcac

SEQ ID NO: 499 - DNA, 20 bp, Homo sapiens
aggaaggcagagagggcact

SEQ ID NO: 500 - DNA, 20 bp, Homo sapiens
aaggcagagagggcactggg

SEQ ID NO: 501 - DNA, 20 bp, Homo sapiens
gcagagagggcactgggagg

SEQ ID NO: 502 - DNA, 20 bp, Homo sapiens
agggcactgggaggaggcag

SEQ ID NO: 503 - DNA, 20 bp, Homo sapiens
gggcactgggaggaggcagt

SEQ ID NO: 504 - DNA, 20 bp, Homo sapiens
cactgggaggaggcagtggg

SEQ ID NO: 505 - DNA, 20 bp, Homo sapiens
actgggaggaggcagtggga

SEQ ID NO: 506 - DNA, 20 bp, Homo sapiens
gggaggaggcagtgggaggg

SEQ ID NO: 507 - DNA, 20 bp, Homo sapiens
aggaggcagtgggagggcgg

SEQ ID NO: 508 - DNA, 20 bp, Homo sapiens
ggaggcagtgggagggcgga

SEQ ID NO: 509 - DNA, 20 bp, Homo sapiens
ggcagtgggagggcggaggg

SEQ ID NO: 510 - DNA, 20 bp, Homo sapiens
gcagtgggagggcggagggc

SEQ ID NO: 511 - DNA, 20 bp, Homo sapiens
cagtgggagggcggagggcg

SEQ ID NO: 512 - DNA, 20 bp, Homo sapiens
agtgggagggcggagggcgg

SEQ ID NO: 513 - DNA, 20 bp, Homo sapiens
gggcggagggcgggggcctt

SEQ ID NO: 514 - DNA, 20 bp, Homo sapiens
ggcggagggcgggggccttc

SEQ ID NO: 515 - DNA, 20 bp, Homo sapiens
gcggagggcgggggccttcg

SEQ ID NO: 516 - DNA, 20 bp, Homo sapiens
gagggcgggggccttcgggg

SEQ ID NO: 517 - DNA, 20 bp, Homo sapiens
agggcgggggccttcggggt

SEQ ID NO: 518 - DNA, 20 bp, Homo sapiens
ggccttcggggtgggcgccc

SEQ ID NO: 519 - DNA, 20 bp, Homo sapiens
gccttcggggtgggcgccca

SEQ ID NO: 520 - DNA, 20 bp, Homo sapiens
cggggtgggcgcccagggta

SEQ ID NO: 521 - DNA, 20 bp, Homo sapiens
gcggccacctgccctaccct

SEQ ID NO: 522 - DNA, 20 bp, Homo sapiens
cgcggccacctgccctaccc

SEQ ID NO: 523 - DNA, 20 bp, Homo sapiens
gtgggcgcccagggtagggc

SEQ ID NO: 524 - DNA, 20 bp, Homo sapiens
ggcgcccagggtagggcagg

SEQ ID NO: 525 - DNA, 20 bp, Homo sapiens
cagggtagggcaggtggccg

SEQ ID NO: 526 - DNA, 20 bp, Homo sapiens
tagggcaggtggccgcggcg

SEQ ID NO: 527 - DNA, 20 bp, Homo sapiens
ggcaggtggccgcggcgtgg

SEQ ID NO: 528 - DNA, 20 bp, Homo sapiens
ggtggccgcggcgtggaggc

SEQ ID NO: 529 - DNA, 20 bp, Homo sapiens
gtggccgcggcgtggaggca

SEQ ID NO: 530 - DNA, 20 bp, Homo sapiens
gtccatgtcgacgagggttt

SEQ ID NO: 531 - DNA, 20 bp, Homo sapiens
ggccatgtccatgtcgacga

SEQ ID NO: 532 - DNA, 20 bp, Homo sapiens
cggccatgtccatgtcgacg

SEQ ID NO: 533 - DNA, 20 bp, Homo sapiens
ctccaaaaccctcgtcgaca

SEQ ID NO: 534 - DNA, 20 bp, Homo sapiens
aaccctcgtcgacatggaca

SEQ ID NO: 535 - DNA, 20 bp, Homo sapiens
gtccagtgcagcactgtagt

SEQ ID NO: 536 - DNA, 20 bp, Homo sapiens
ggccgactacagtgctgcac

SEQ ID NO: 537 - DNA, 20 bp, Homo sapiens
attccagggtggtgtaggct

SEQ ID NO: 538 - DNA, 20 bp, Homo sapiens
aattccagggtggtgtaggc

SEQ ID NO: 539 - DNA, 20 bp, Homo sapiens
ctcaaattccagggtggtgt

SEQ ID NO: 540 - DNA, 20 bp, Homo sapiens
ggacccagcctacaccaccc

SEQ ID NO: 541 - DNA, 20 bp, Homo sapiens
cacattctcaaattccaggg

SEQ ID NO: 542 - DNA, 20 bp, Homo sapiens
ctgcacattctcaaattcca

SEQ ID NO: 543 - DNA, 20 bp, Homo sapiens
cctgcacattctcaaattcc

SEQ ID NO: 544 - DNA, 20 bp, Homo sapiens
cctggaatttgagaatgtgc

SEQ ID NO: 545 - DNA, 20 bp, Homo sapiens
gaatgtgcaggtgttgacga

SEQ ID NO: 546 - DNA, 20 bp, Homo sapiens
aatgtgcaggtgttgacgat

SEQ ID NO: 547 - DNA, 20 bp, Homo sapiens
caggtgttgacgatgggcaa

SEQ ID NO: 548 - DNA, 20 bp, Homo sapiens
tgttgacgatgggcaatggt

SEQ ID NO: 549 - DNA, 20 bp, Homo sapiens
tgacgatgggcaatggtagg

SEQ ID NO: 550 - DNA, 20 bp, Homo sapiens
gacgatgggcaatggtaggt

SEQ ID NO: 551 - DNA, 20 bp, Homo sapiens
acgatgggcaatggtaggtg

SEQ ID NO: 552 - DNA, 20 bp, Homo sapiens
cgatgggcaatggtaggtgg

SEQ ID NO: 553 - DNA, 20 bp, Homo sapiens
aggtgggggcagatgtgccc

SEQ ID NO: 554 - DNA, 20 bp, Homo sapiens
ctgcccccactggcacacct

SEQ ID NO: 555 - DNA, 20 bp, Homo sapiens
cctgcccccactggcacacc

SEQ ID NO: 556 - DNA, 20 bp, Homo sapiens
gatgtgcccaggtgtgccag

SEQ ID NO: 557 - DNA, 20 bp, Homo sapiens
atgtgcccaggtgtgccagt

SEQ ID NO: 558 - DNA, 20 bp, Homo sapiens
tgtgcccaggtgtgccagtg

SEQ ID NO: 559 - DNA, 20 bp, Homo sapiens
gtgcccaggtgtgccagtgg

SEQ ID NO: 560 - DNA, 20 bp, Homo sapiens
ccaggcacacctgcccccac

SEQ ID NO: 561 - DNA, 20 bp, Homo sapiens
ccaggtgtgccagtgggggc

SEQ ID NO: 562 - DNA, 20 bp, Homo sapiens
ccagtgggggcaggtgtgcc

SEQ ID NO: 563 - DNA, 20 bp, Homo sapiens
cagtgggggcaggtgtgcct

SEQ ID NO: 564 - DNA, 20 bp, Homo sapiens
gggcaggtgtgcctgggtcc

SEQ ID NO: 565 - DNA, 20 bp, Homo sapiens
aaagatctgctcctggaccc

SEQ ID NO: 566 - DNA, 20 bp, Homo sapiens
gagtgccaaagatctgctcc

SEQ ID NO: 567 - DNA, 20 bp, Homo sapiens
tgggtccaggagcagatctt

SEQ ID NO: 568 - DNA, 20 bp, Homo sapiens
agatctttggcactcaactt

SEQ ID NO: 569 - DNA, 20 bp, Homo sapiens
gatctttggcactcaacttt

SEQ ID NO: 570 - DNA, 20 bp, Homo sapiens
atctttggcactcaactttg

SEQ ID NO: 571 - DNA, 20 bp, Homo sapiens
tttggcactcaactttgggg

SEQ ID NO: 572 - DNA, 20 bp, Homo sapiens
ttggcactcaactttggggt

SEQ ID NO: 573 - DNA, 20 bp, Homo sapiens
gcactcaactttggggtggg

SEQ ID NO: 574 - DNA, 20 bp, Homo sapiens
gggaggagaatgatacaaaa

SEQ ID NO: 575 - DNA, 20 bp, Homo sapiens
ggagaatgatacaaaatggt

SEQ ID NO: 576 - DNA, 20 bp, Homo sapiens
aatgatacaaaatggtaggt

SEQ ID NO: 577 - DNA, 20 bp, Homo sapiens
aaatggtaggttggtcctac

SEQ ID NO: 578 - DNA, 20 bp, Homo sapiens
caacacctgtgctggcctgt

SEQ ID NO: 579 - DNA, 20 bp, Homo sapiens
ttggtcctacaggccagcac

SEQ ID NO: 580 - DNA, 20 bp, Homo sapiens
tcacttggcaacacctgtgc

SEQ ID NO: 581 - DNA, 20 bp, Homo sapiens
ctgggcacatgggcttcact

SEQ ID NO: 582 - DNA, 20 bp, Homo sapiens
atcactgtgcctgggcacat

SEQ ID NO: 583 - DNA, 20 bp, Homo sapiens
gatcactgtgcctgggcaca

SEQ ID NO: 584 - DNA, 20 bp, Homo sapiens
caagtgaagcccatgtgccc

SEQ ID NO: 585 - DNA, 20 bp, Homo sapiens
tgcctgtgatcactgtgcct

SEQ ID NO: 586 - DNA, 20 bp, Homo sapiens
atgcctgtgatcactgtgcc

SEQ ID NO: 587 - DNA, 20 bp, Homo sapiens
tgcccaggcacagtgatcac

SEQ ID NO: 588 - DNA, 20 bp, Homo sapiens
cacagtgatcacaggcattc

SEQ ID NO: 589 - DNA, 20 bp, Homo sapiens
acagtgatcacaggcattct

SEQ ID NO: 590 - DNA, 20 bp, Homo sapiens
atcacaggcattctgggtga

SEQ ID NO: 591 - DNA, 20 bp, Homo sapiens
tcacaggcattctgggtgaa

SEQ ID NO: 592 - DNA, 20 bp, Homo sapiens
caggcattctgggtgaaggg

SEQ ID NO: 593 - DNA, 20 bp, Homo sapiens
tgggtgaagggaggcctgca

SEQ ID NO: 594 - DNA, 20 bp, Homo sapiens
gggtgaagggaggcctgcaa

SEQ ID NO: 595 - DNA, 20 bp, Homo sapiens
tgctggaaattggcccttgc

SEQ ID NO: 596 - DNA, 100 bp, Artificial Sequence
  source: /note="Description of Artificial Sequence: Synthetic polynucleotide"
ccctcacccccaccccctccgttttagagctagaaatagcaagttaaaataaggctagtccgttatcaacttgaaaaagtggcaccgagtcggtgctttt

SEQ ID NO: 597 - DNA, 100 bp, Artificial Sequence
  source: /note="Description of Artificial Sequence: Synthetic polynucleotide"
tccgggagggggtgggggtggttttagagctagaaatagcaagttaaaataaggctagtccgttatcaacttgaaaaagtggcaccgagtcggtgctttt

SEQ ID NO: 598 - DNA, 100 bp, Artificial Sequence
  source: /note="Description of Artificial Sequence: Synthetic polynucleotide"
ccgggagggggtgggggtgagttttagagctagaaatagcaagttaaaataaggctagtccgttatcaacttgaaaaagtggcaccgagtcggtgctttt

SEQ ID NO: 599 - DNA, 100 bp, Artificial Sequence
  source: /note="Description of Artificial Sequence: Synthetic polynucleotide"
ggggtgggggtgagggaaacgttttagagctagaaatagcaagttaaaataaggctagtccgttatcaacttgaaaaagtggcaccgagtcggtgctttt

SEQ ID NO: 600 - DNA, 100 bp, Artificial Sequence
  source: /note="Description of Artificial Sequence: Synthetic polynucleotide"
agggaaacaggagaatgtgagttttagagctagaaatagcaagttaaaataaggctagtccgttatcaacttgaaaaagtggcaccgagtcggtgctttt

SEQ ID NO: 601 - DNA, 100 bp, Artificial Sequence
  source: /note="Description of Artificial Sequence: Synthetic polynucleotide"
gggaaacaggagaatgtgatgttttagagctagaaatagcaagttaaaataaggctagtccgttatcaacttgaaaaagtggcaccgagtcggtgctttt

SEQ ID NO: 602 - DNA, 100 bp, Artificial Sequence
  source: /note="Description of Artificial Sequence: Synthetic polynucleotide"
tgtgatgggaaaatccgagagttttagagctagaaatagcaagttaaaataaggctagtccgttatcaacttgaaaaagtggcaccgagtcggtgctttt

SEQ ID NO: 603 - DNA, 100 bp, Artificial Sequence
  source: /note="Description of Artificial Sequence: Synthetic polynucleotide"
ggcccaggctggctccatctgttttagagctagaaatagcaagttaaaataaggctagtccgttatcaacttgaaaaagtggcaccgagtcggtgctttt

SEQ ID NO: 604 - DNA, 100 bp, Artificial Sequence
  source: /note="Description of Artificial Sequence: Synthetic polynucleotide"
aatccgagatggagccagccgttttagagctagaaatagcaagttaaaataaggctagtccgttatcaacttgaaaaagtggcaccgagtcggtgctttt

SEQ ID NO: 605 - DNA, 100 bp, Artificial Sequence
  source: /note="Description of Artificial Sequence: Synthetic polynucleotide"
atccgagatggagccagcctgttttagagctagaaatagcaagttaaaataaggctagtccgttatcaacttgaaaaagtggcaccgagtcggtgctttt

SEQ ID NO: 606 - DNA, 100 bp, Artificial Sequence
  source: /note="Description of Artificial Sequence: Synthetic polynucleotide"
ccagtgtttctggcccaggcgttttagagctagaaatagcaagttaaaataaggctagtccgttatcaacttgaaaaagtggcaccgagtcggtgctttt

SEQ ID NO: 607 - DNA, 100 bp, Artificial Sequence
  source: /note="Description of Artificial Sequence: Synthetic polynucleotide"
gctcccagtgtttctggcccgttttagagctagaaatagcaagttaaaataaggctagtccgttatcaacttgaaaaagtggcaccgagtcggtgctttt

SEQ ID NO: 608 - DNA, 100 bp, Artificial Sequence
  source: /note="Description of Artificial Sequence: Synthetic polynucleotide"
cccacagctcccagtgtttcgttttagagctagaaatagcaagttaaaataaggctagtccgttatcaacttgaaaaagtggcaccgagtcggtgctttt

SEQ ID NO: 609 - DNA, 100 bp, Artificial Sequence
  source: /note="Description of Artificial Sequence: Synthetic polynucleotide"
ccagcctgggccagaaacacgttttagagctagaaatagcaagttaaaataaggctagtccgttatcaacttgaaaaagtggcaccgagtcggtgctttt

SEQ ID NO: 610 - DNA, 100 bp, Artificial Sequence
  source: /note="Description of Artificial Sequence: Synthetic polynucleotide"
cagcctgggccagaaacactgttttagagctagaaatagcaagttaaaataaggctagtccgttatcaacttgaaaaagtggcaccgagtcggtgctttt

SEQ ID NO: 611 - DNA, 100 bp, Artificial Sequence
  source: /note="Description of Artificial Sequence: Synthetic polynucleotide"
gccagaaacactgggagctggttttagagctagaaatagcaagttaaaataaggctagtccgttatcaacttgaaaaagtggcaccgagtcggtgctttt

SEQ ID NO: 612 - DNA, 100 bp, Artificial Sequence
  source: /note="Description of Artificial Sequence: Synthetic polynucleotide"
ccagaaacactgggagctgtgttttagagctagaaatagcaagttaaaataaggctagtccgttatcaacttgaaaaagtggcaccgagtcggtgctttt

SEQ ID NO: 613 - DNA, 100 bp, Artificial Sequence
  source: /note="Description of Artificial Sequence: Synthetic polynucleotide"
acactgggagctgtgggagagttttagagctagaaatagcaagttaaaataaggctagtccgttatcaacttgaaaaagtggcaccgagtcggtgctttt

SEQ ID NO: 614 - DNA, 100 bp, Artificial Sequence
  source: /note="Description of Artificial Sequence: Synthetic polynucleotide"
gggagctgtgggagacggaggttttagagctagaaatagcaagttaaaataaggctagtccgttatcaacttgaaaaagtggcaccgagtcggtgctttt

SEQ ID NO: 615 - DNA, 100 bp, Artificial Sequence
  source: /note="Description of Artificial Sequence: Synthetic polynucleotide"
ggagctgtgggagacggagagttttagagctagaaatagcaagttaaaataaggctagtccgttatcaacttgaaaaagtggcaccgagtcggtgctttt

SEQ ID NO: 616 - DNA, 100 bp, Artificial Sequence
  source: /note="Description of Artificial Sequence: Synthetic polynucleotide"
gagctgtgggagacggagaggttttagagctagaaatagcaagttaaaataaggctagtccgttatcaacttgaaaaagtggcaccgagtcggtgctttt

SEQ ID NO: 617 - DNA, 100 bp, Artificial Sequence
  source: /note="Description of Artificial Sequence: Synthetic polynucleotide"
tgtgggagacggagaggggcgttttagagctagaaatagcaagttaaaataaggctagtccgttatcaacttgaaaaagtggcaccgagtcggtgctttt

SEQ ID NO: 618 - DNA, 100 bp, Artificial Sequence
  source: /note="Description of Artificial Sequence: Synthetic polynucleotide"
gtgggagacggagaggggcagttttagagctagaaatagcaagttaaaataaggctagtccgttatcaacttgaaaaagtggcaccgagtcggtgctttt

SEQ ID NO: 619 - DNA, 100 bp, Artificial Sequence
  source: /note="Description of Artificial Sequence: Synthetic polynucleotide"
ggagacggagaggggcaggggttttagagctagaaatagcaagttaaaataaggctagtccgttatcaacttgaaaaagtggcaccgagtcggtgctttt

SEQ ID NO: 620 - DNA, 100 bp, Artificial Sequence
  source: /note="Description of Artificial Sequence: Synthetic polynucleotide"
gagacggagaggggcagggtgttttagagctagaaatagcaagttaaaataaggctagtccgttatcaacttgaaaaagtggcaccgagtcggtgctttt

SEQ ID NO: 621 - DNA, 100 bp, Artificial Sequence
  source: /note="Description of Artificial Sequence: Synthetic polynucleotide"
gaggggcagggtgggatcacgttttagagctagaaatagcaagttaaaataaggctagtccgttatcaacttgaaaaagtggcaccgagtcggtgctttt

SEQ ID NO: 622 - DNA, 100 bp, Artificial Sequence
  source: /note="Description of Artificial Sequence: Synthetic polynucleotide"
aggggcagggtgggatcacagttttagagctagaaatagcaagttaaaataaggctagtccgttatcaacttgaaaaagtggcaccgagtcggtgctttt

SEQ ID NO: 623 - DNA, 100 bp, Artificial Sequence
  source: /note="Description of Artificial Sequence: Synthetic polynucleotide"
agggtgggatcacagggagcgttttagagctagaaatagcaagttaaaataaggctagtccgttatcaacttgaaaaagtggcaccgagtcggtgctttt

SEQ ID NO: 624 - DNA, 100 bp, Artificial Sequence
  source: /note="Description of Artificial Sequence: Synthetic polynucleotide"
gggatcacagggagcaggaggttttagagctagaaatagcaagttaaaataaggctagtccgttatcaacttgaaaaagtggcaccgagtcggtgctttt

SEQ ID NO: 625 - DNA, 100 bp, Artificial Sequence
  source: /note="Description of Artificial Sequence: Synthetic polynucleotide"
ggatcacagggagcaggagcgttttagagctagaaatagcaagttaaaataaggctagtccgttatcaacttgaaaaagtggcaccgagtcggtgctttt

SEQ ID NO: 626 - DNA, 100 bp, Artificial Sequence
  source: /note="Description of Artificial Sequence: Synthetic polynucleotide"
gatcacagggagcaggagcggttttagagctagaaatagcaagttaaaataaggctagtccgttatcaacttgaaaaagtggcaccgagtcggtgctttt

SEQ ID NO: 627 - DNA, 100 bp, Artificial Sequence
  source: /note="Description of Artificial Sequence: Synthetic polynucleotide"
agggagcaggagcggggaatgttttagagctagaaatagcaagttaaaataaggctagtccgttatcaacttgaaaaagtggcaccgagtcggtgctttt

SEQ ID NO: 628 - DNA, 100 bp, Artificial Sequence
  source: /note="Description of Artificial Sequence: Synthetic polynucleotide"
gagcaggagcggggaattgggttttagagctagaaatagcaagttaaaataaggctagtccgttatcaacttgaaaaagtggcaccgagtcggtgctttt

SEQ ID NO: 629 - DNA, 100 bp, Artificial Sequence
  source: /note="Description of Artificial Sequence: Synthetic polynucleotide"
cggggaattggaggtgaatcgttttagagctagaaatagcaagttaaaataaggctagtccgttatcaacttgaaaaagtggcaccgagtcggtgctttt

SEQ ID NO: 630 - DNA, 100 bp, Artificial Sequence
  source: /note="Description of Artificial Sequence: Synthetic polynucleotide"
aatggactggaagtttgggagttttagagctagaaatagcaagttaaaataaggctagtccgttatcaacttgaaaaagtggcaccgagtcggtgctttt

SEQ ID NO: 631 - DNA, 100 bp, Artificial Sequence
  source: /note="Description of Artificial Sequence: Synthetic polynucleotide"
gaatggactggaagtttggggttttagagctagaaatagcaagttaaaataaggctagtccgttatcaacttgaaaaagtggcaccgagtcggtgctttt

SEQ ID NO: 632 - DNA, 100 bp, Artificial Sequence
  source: /note="Description of Artificial Sequence: Synthetic polynucleotide"
gcagaatggactggaagtttgttttagagctagaaatagcaagttaaaataaggctagtccgttatcaacttgaaaaagtggcaccgagtcggtgctttt

SEQ ID NO: 633 - DNA, 100 bp, Artificial Sequence
  source: /note="Description of Artificial Sequence: Synthetic polynucleotide"
agcagaatggactggaagttgttttagagctagaaatagcaagttaaaataaggctagtccgttatcaacttgaaaaagtggcaccgagtcggtgctttt

SEQ ID NO: 634 - DNA, 100 bp, Artificial Sequence
  source: /note="Description of Artificial Sequence: Synthetic polynucleotide"
cccctgggagcagaatggacgttttagagctagaaatagcaagttaaaataaggctagtccgttatcaacttgaaaaagtggcaccgagtcggtgctttt

SEQ ID NO: 635 - DNA, 100 bp, Artificial Sequence
  source: /note="Description of Artificial Sequence: Synthetic polynucleotide"
cggttcccctgggagcagaagttttagagctagaaatagcaagttaaaataaggctagtccgttatcaacttgaaaaagtggcaccgagtcggtgctttt

SEQ ID NO: 636 - DNA, 100 bp, Artificial Sequence
  source: /note="Description of Artificial Sequence: Synthetic polynucleotide"
ttccagtccattctgctcccgttttagagctagaaatagcaagttaaaataaggctagtccgttatcaacttgaaaaagtggcaccgagtcggtgctttt

SEQ ID NO: 637 - DNA, 100 bp, Artificial Sequence
  source: /note="Description of Artificial Sequence: Synthetic polynucleotide"
tccagtccattctgctcccagttttagagctagaaatagcaagttaaaataaggctagtccgttatcaacttgaaaaagtggcaccgagtcggtgctttt

SEQ ID NO: 638 - DNA, 100 bp, Artificial Sequence
  source: /note="Description of Artificial Sequence: Synthetic polynucleotide"
ccagtccattctgctcccaggttttagagctagaaatagcaagttaaaataaggctagtccgttatcaacttgaaaaagtggcaccgagtcggtgctttt

SEQ ID NO: 639 - DNA, 100 bp, Artificial Sequence
  source: /note="Description of Artificial Sequence: Synthetic polynucleotide"
cgcagtttcccggttcccctgttttagagctagaaatagcaagttaaaataaggctagtccgttatcaacttgaaaaagtggcaccgagtcggtgctttt

SEQ ID NO: 640 - DNA, 100 bp, Artificial Sequence
  source: /note="Description of Artificial Sequence: Synthetic polynucleotide"
ccgcagtttcccggttccccgttttagagctagaaatagcaagttaaaataaggctagtccgttatcaacttgaaaaagtggcaccgagtcggtgctttt

SEQ ID NO: 641 - DNA, 100 bp, Artificial Sequence
  source: /note="Description of Artificial Sequence: Synthetic polynucleotide"
cattctgctcccaggggaacgttttagagctagaaatagcaagttaaaataaggctagtccgttatcaacttgaaaaagtggcaccgagtcggtgctttt

SEQ ID NO: 642 - DNA, 100 bp, Artificial Sequence
  source: /note="Description of Artificial Sequence: Synthetic polynucleotide"
attctgctcccaggggaaccgttttagagctagaaatagcaagttaaaataaggctagtccgttatcaacttgaaaaagtggcaccgagtcggtgctttt

SEQ ID NO: 643 - DNA, 100 bp, Artificial Sequence
  source: /note="Description of Artificial Sequence: Synthetic polynucleotide"
ccagttcccccgcagtttccgttttagagctagaaatagcaagttaaaataaggctagtccgttatcaacttgaaaaagtggcaccgagtcggtgctttt

SEQ ID NO: 644 - DNA, 100 bp, Artificial Sequence
  source: /note="Description of Artificial Sequence: Synthetic polynucleotide"
ccaggggaaccgggaaactggttttagagctagaaatagcaagttaaaataaggctagtccgttatcaacttgaaaaagtggcaccgagtcggtgctttt

SEQ ID NO: 645 - DNA, 100 bp, Artificial Sequence
  source: /note="Description of Artificial Sequence: Synthetic polynucleotide"
caggggaaccgggaaactgcgttttagagctagaaatagcaagttaaaataaggctagtccgttatcaacttgaaaaagtggcaccgagtcggtgctttt

SEQ ID NO: 646 - DNA, 100 bp, Artificial Sequence
  source: /note="Description of Artificial Sequence: Synthetic polynucleotide"
aggggaaccgggaaactgcggttttagagctagaaatagcaagttaaaataaggctagtccgttatcaacttgaaaaagtggcaccgagtcggtgctttt

SEQ ID NO: 647 - DNA, 100 bp, Artificial Sequence
  source: /note="Description of Artificial Sequence: Synthetic polynucleotide"
ggggaaccgggaaactgcgggttttagagctagaaatagcaagttaaaataaggctagtccgttatcaacttgaaaaagtggcaccgagtcggtgctttt

SEQ ID NO: 648 - DNA, 100 bp, Artificial Sequence
  source: /note="Description of Artificial Sequence: Synthetic polynucleotide"
ccgggaaactgcgggggaacgttttagagctagaaatagcaagttaaaataaggctagtccgttatcaacttgaaaaagtggcaccgagtcggtgctttt

SEQ ID NO: 649 - DNA, 100 bp, Artificial Sequence
  source: /note="Description of Artificial Sequence: Synthetic polynucleotide"
gaaactgcgggggaactggagttttagagctagaaatagcaagttaaaataaggctagtccgttatcaacttgaaaaagtggcaccgagtcggtgctttt

SEQ ID NO: 650 - DNA, 100 bp, Artificial Sequence
  source: /note="Description of Artificial Sequence: Synthetic polynucleotide"
aaactgcgggggaactggaagttttagagctagaaatagcaagttaaaataaggctagtccgttatcaacttgaaaaagtggcaccgagtcggtgctttt

SEQ ID NO: 651 - DNA, 100 bp, Artificial Sequence
  source: /note="Description of Artificial Sequence: Synthetic polynucleotide"
ggaagggagctcccagaacagttttagagctagaaatagcaagttaaaataaggctagtccgttatcaacttgaaaaagtggcaccgagtcggtgctttt

SEQ ID NO: 652 - DNA, 100 bp, Artificial Sequence
  source: /note="Description of Artificial Sequence: Synthetic polynucleotide"
atcttctggatccttgttctgttttagagctagaaatagcaagttaaaataaggctagtccgttatcaacttgaaaaagtggcaccgagtcggtgctttt

SEQ ID NO: 653 - DNA, 100 bp, Artificial Sequence
  source: /note="Description of Artificial Sequence: Synthetic polynucleotide"
aatcttctggatccttgttcgttttagagctagaaatagcaagttaaaataaggctagtccgttatcaacttgaaaaagtggcaccgagtcggtgctttt

SEQ ID NO: 654 - DNA, 100 bp, Artificial Sequence
  source: /note="Description of Artificial Sequence: Synthetic polynucleotide"
agaacaaggatccagaagatgttttagagctagaaatagcaagttaaaataaggctagtccgttatcaacttgaaaaagtggcaccgagtcggtgctttt

SEQ ID NO: 655 - DNA, 100 bp, Artificial Sequence
  source: /note="Description of Artificial Sequence: Synthetic polynucleotide"
ggccccagatgccaatcttcgttttagagctagaaatagcaagttaaaataaggctagtccgttatcaacttgaaaaagtggcaccgagtcggtgctttt

SEQ ID NO: 656 - DNA, 100 bp, Artificial Sequence
  source: /note="Description of Artificial Sequence: Synthetic polynucleotide"
ggatccagaagattggcatcgttttagagctagaaatagcaagttaaaataaggctagtccgttatcaacttgaaaaagtggcaccgagtcggtgctttt

SEQ ID NO: 657 - DNA, 100 bp, Artificial Sequence
  source: /note="Description of Artificial Sequence: Synthetic polynucleotide"
gatccagaagattggcatctgttttagagctagaaatagcaagttaaaataaggctagtccgttatcaacttgaaaaagtggcaccgagtcggtgctttt

SEQ ID NO: 658 - DNA, 100 bp, Artificial Sequence
  source: /note="Description of Artificial Sequence: Synthetic polynucleotide"
atccagaagattggcatctggttttagagctagaaatagcaagttaaaataaggctagtccgttatcaacttgaaaaagtggcaccgagtcggtgctttt

SEQ ID NO: 659 - DNA, 100 bp, Artificial Sequence
  source: /note="Description of Artificial Sequence: Synthetic polynucleotide"
gaagattggcatctggggccgttttagagctagaaatagcaagttaaaataaggctagtccgttatcaacttgaaaaagtggcaccgagtcggtgctttt

SEQ ID NO: 660 - DNA, 100 bp, Artificial Sequence
  source: /note="Description of Artificial Sequence: Synthetic polynucleotide"
aagattggcatctggggcctgttttagagctagaaatagcaagttaaaataaggctagtccgttatcaacttgaaaaagtggcaccgagtcggtgctttt

SEQ ID NO: 661 - DNA, 100 bp, Artificial Sequence
  source: /note="Description of Artificial Sequence: Synthetic polynucleotide"
gatttagaaacctaaatcccgttttagagctagaaatagcaagttaaaataaggctagtccgttatcaacttgaaaaagtggcaccgagtcggtgctttt

SEQ ID NO: 662 - DNA, 100 bp, Artificial Sequence
  source: /note="Description of Artificial Sequence: Synthetic polynucleotide"
gcatctggggcctgggatttgttttagagctagaaatagcaagttaaaataaggctagtccgttatcaacttgaaaaagtggcaccgagtcggtgctttt

SEQ ID NO: 663 - DNA, 100 bp, Artificial Sequence
  source: /note="Description of Artificial Sequence: Synthetic polynucleotide"
ggatttaggtttctaaatcggttttagagctagaaatagcaagttaaaataaggctagtccgttatcaacttgaaaaagtggcaccgagtcggtgctttt

SEQ ID NO: 664 - DNA, 100 bp, Artificial Sequence
  source: /note="Description of Artificial Sequence: Synthetic polynucleotide"
gatttaggtttctaaatcgtgttttagagctagaaatagcaagttaaaataaggctagtccgttatcaacttgaaaaagtggcaccgagtcggtgctttt

SEQ ID NO: 665 - DNA, 100 bp, Artificial Sequence
  source: /note="Description of Artificial Sequence: Synthetic polynucleotide"
ggtttctaaatcgtgggccagttttagagctagaaatagcaagttaaaataaggctagtccgttatcaacttgaaaaagtggcaccgagtcggtgctttt

SEQ ID NO: 666 - DNA, 100 bp, Artificial Sequence
  source: /note="Description of Artificial Sequence: Synthetic polynucleotide"
gtttctaaatcgtgggccatgttttagagctagaaatagcaagttaaaataaggctagtccgttatcaacttgaaaaagtggcaccgagtcggtgctttt

SEQ ID NO: 667 - DNA, 100 bp, Artificial Sequence
  source: /note="Description of Artificial Sequence: Synthetic polynucleotide"
tttctaaatcgtgggccatggttttagagctagaaatagcaagttaaaataaggctagtccgttatcaacttgaaaaagtggcaccgagtcggtgctttt

SEQ ID NO: 668 - DNA, 100 bp, Artificial Sequence
  source: /note="Description of Artificial Sequence: Synthetic polynucleotide"
gcagagataaggctgccccagttttagagctagaaatagcaagttaaaataaggctagtccgttatcaacttgaaaaagtggcaccgagtcggtgctttt

SEQ ID NO: 669 - DNA, 100 bp, Artificial Sequence
  source: /note="Description of Artificial Sequence: Synthetic polynucleotide"
tcaatgcttttgcagagatagttttagagctagaaatagcaagttaaaataaggctagtccgttatcaacttgaaaaagtggcaccgagtcggtgctttt

SEQ ID NO: 670 - DNA, 100 bp, Artificial Sequence
  source: /note="Description of Artificial Sequence: Synthetic polynucleotide"
ttatctctgcaaaagcattggttttagagctagaaatagcaagttaaaataaggctagtccgttatcaacttgaaaaagtggcaccgagtcggtgctttt

SEQ ID NO: 671 - DNA, 100 bp, Artificial Sequence
  source: /note="Description of Artificial Sequence: Synthetic polynucleotide"
tatctctgcaaaagcattgagttttagagctagaaatagcaagttaaaataaggctagtccgttatcaacttgaaaaagtggcaccgagtcggtgctttt

SEQ ID NO: 672 - DNA, 100 bp, Artificial Sequence
  source: /note="Description of Artificial Sequence: Synthetic polynucleotide"
gagggtagaagtcaatgattgttttagagctagaaatagcaagttaaaataaggctagtccgttatcaacttgaaaaagtggcaccgagtcggtgctttt

SEQ ID NO: 673 - DNA, 100 bp, Artificial Sequence
  source: /note="Description of Artificial Sequence: Synthetic polynucleotide"
agggtagaagtcaatgatttgttttagagctagaaatagcaagttaaaataaggctagtccgttatcaacttgaaaaagtggcaccgagtcggtgctttt

SEQ ID NO: 674 - DNA, 100 bp, Artificial Sequence
  source: /note="Description of Artificial Sequence: Synthetic polynucleotide"
atttgggaagttattgaattgttttagagctagaaatagcaagttaaaataaggctagtccgttatcaacttgaaaaagtggcaccgagtcggtgctttt

SEQ ID NO: 675 - DNA, 100 bp, Artificial Sequence
  source: /note="Description of Artificial Sequence: Synthetic polynucleotide"
tttgggaagttattgaattagttttagagctagaaatagcaagttaaaataaggctagtccgttatcaacttgaaaaagtggcaccgagtcggtgctttt

SEQ ID NO: 676 - DNA, 100 bp, Artificial Sequence
  source: /note="Description of Artificial Sequence: Synthetic polynucleotide"
ttgggaagttattgaattaggttttagagctagaaatagcaagttaaaataaggctagtccgttatcaacttgaaaaagtggcaccgagtcggtgctttt

SEQ ID NO: 677 - DNA, 100 bp, Artificial Sequence
  source: /note="Description of Artificial Sequence: Synthetic polynucleotide"
gttattgaattaggggatctgttttagagctagaaatagcaagttaaaataaggctagtccgttatcaacttgaaaaagtggcaccgagtcggtgctttt

SEQ ID NO: 678 - DNA, 100 bp, Artificial Sequence
  source: /note="Description of Artificial Sequence: Synthetic polynucleotide"
attgaattaggggatctcgggttttagagctagaaatagcaagttaaaataaggctagtccgttatcaacttgaaaaagtggcaccgagtcggtgctttt

SEQ ID NO: 679 - DNA, 100 bp, Artificial Sequence
  source: /note="Description of Artificial Sequence: Synthetic polynucleotide"
aattaggggatctcggaggtgttttagagctagaaatagcaagttaaaataaggctagtccgttatcaacttgaaaaagtggcaccgagtcggtgctttt

SEQ ID NO: 680 - DNA, 100 bp, Artificial Sequence
  source: /note="Description of Artificial Sequence: Synthetic polynucleotide"
gcattctaactgatactatcgttttagagctagaaatagcaagttaaaataaggctagtccgttatcaacttgaaaaagtggcaccgagtcggtgctttt

SEQ ID NO: 681 - DNA, 100 bp, Artificial Sequence
  source: /note="Description of Artificial Sequence: Synthetic polynucleotide"
atcagttagaatgcctgactgttttagagctagaaatagcaagttaaaataaggctagtccgttatcaacttgaaaaagtggcaccgagtcggtgctttt

SEQ ID NO: 682 - DNA, 100 bp, Artificial Sequence
  source: /note="Description of Artificial Sequence: Synthetic polynucleotide"
tcagttagaatgcctgacttgttttagagctagaaatagcaagttaaaataaggctagtccgttatcaacttgaaaaagtggcaccgagtcggtgctttt

SEQ ID NO: 683 - DNA, 100 bp, Artificial Sequence
  source: /note="Description of Artificial Sequence: Synthetic polynucleotide"
cagttagaatgcctgacttggttttagagctagaaatagcaagttaaaataaggctagtccgttatcaacttgaaaaagtggcaccgagtcggtgctttt

SEQ ID NO: 684 - DNA, 100 bp, Artificial Sequence
  source: /note="Description of Artificial Sequence: Synthetic polynucleotide"
agccattgtcaccccaagtcgttttagagctagaaatagcaagttaaaataaggctagtccgttatcaacttgaaaaagtggcaccgagtcggtgctttt

SEQ ID NO: 685 - DNA, 100 bp, Artificial Sequence
  source: /note="Description of Artificial Sequence: Synthetic polynucleotide"
tgcctgacttggggtgacaagttttagagctagaaatagcaagttaaaataaggctagtccgttatcaacttgaaaaagtggcaccgagtcggtgctttt

SEQ ID NO: 686 - DNA, 100 bp, Artificial Sequence
  source: /note="Description of Artificial Sequence: Synthetic polynucleotide"
gacttggggtgacaatggctgttttagagctagaaatagcaagttaaaataaggctagtccgttatcaacttgaaaaagtggcaccgagtcggtgctttt

SEQ ID NO: 687 - DNA, 100 bp, Artificial Sequence
  source: /note="Description of Artificial Sequence: Synthetic polynucleotide"
ttggggtgacaatggcttgggttttagagctagaaatagcaagttaaaataaggctagtccgttatcaacttgaaaaagtggcaccgagtcggtgctttt

SEQ ID NO: 688 - DNA, 100 bp, Artificial Sequence
  source: /note="Description of Artificial Sequence: Synthetic polynucleotide"
tggggtgacaatggcttggagttttagagctagaaatagcaagttaaaataaggctagtccgttatcaacttgaaaaagtggcaccgagtcggtgctttt

SEQ ID NO: 689 - DNA, 100 bp, Artificial Sequence
  source: /note="Description of Artificial Sequence: Synthetic polynucleotide"
ggggtgacaatggcttggaggttttagagctagaaatagcaagttaaaataaggctagtccgttatcaacttgaaaaagtggcaccgagtcggtgctttt

SEQ ID NO: 690 - DNA, 100 bp, Artificial Sequence
  source: /note="Description of Artificial Sequence: Synthetic polynucleotide"
gtgacaatggcttggagggggttttagagctagaaatagcaagttaaaataaggctagtccgttatcaacttgaaaaagtggcaccgagtcggtgctttt

SEQ ID NO: 691 - DNA, 100 bp, Artificial Sequence
  source: /note="Description of Artificial Sequence: Synthetic polynucleotide"
tgacaatggcttggaggggtgttttagagctagaaatagcaagttaaaataaggctagtccgttatcaacttgaaaaagtggcaccgagtcggtgctttt

SEQ ID NO: 692 - DNA, 100 bp, Artificial Sequence
  source: /note="Description of Artificial Sequence: Synthetic polynucleotide"
ttggaggggtgggtgagtcagttttagagctagaaatagcaagttaaaataaggctagtccgttatcaacttgaaaaagtggcaccgagtcggtgctttt

SEQ ID NO: 693 - DNA, 100 bp, Artificial Sequence
  source: /note="Description of Artificial Sequence: Synthetic polynucleotide"
tggaggggtgggtgagtcaagttttagagctagaaatagcaagttaaaataaggctagtccgttatcaacttgaaaaagtggcaccgagtcggtgctttt

SEQ ID NO: 694 - DNA, 100 bp, Artificial Sequence
  source: /note="Description of Artificial Sequence: Synthetic polynucleotide"
aggcaggcatcatgactcacgttttagagctagaaatagcaagttaaaataaggctagtccgttatcaacttgaaaaagtggcaccgagtcggtgctttt

SEQ ID NO: 695 - DNA, 100 bp, Artificial Sequence
  source: /note="Description of Artificial Sequence: Synthetic polynucleotide"
aaggcaggcatcatgactcagttttagagctagaaatagcaagttaaaataaggctagtccgttatcaacttgaaaaagtggcaccgagtcggtgctttt

SEQ ID NO: 696 - DNA, 100 bp, Artificial Sequence
  source: /note="Description of Artificial Sequence: Synthetic polynucleotide"
agttatcaattgtacaaggcgttttagagctagaaatagcaagttaaaataaggctagtccgttatcaacttgaaaaagtggcaccgagtcggtgctttt

SEQ ID NO: 697 - DNA, 100 bp, Artificial Sequence
  source: /note="Description of Artificial Sequence: Synthetic polynucleotide"
gttcagttatcaattgtacagttttagagctagaaatagcaagttaaaataaggctagtccgttatcaacttgaaaaagtggcaccgagtcggtgctttt

SEQ ID NO: 698 - DNA, 100 bp, Artificial Sequence
  source: /note="Description of Artificial Sequence: Synthetic polynucleotide"
tacaattgataactgaacatgttttagagctagaaatagcaagttaaaataaggctagtccgttatcaacttgaaaaagtggcaccgagtcggtgctttt

SEQ ID NO: 699 - DNA, 100 bp, Artificial Sequence
  source: /note="Description of Artificial Sequence: Synthetic polynucleotide"
taactgaacatcggtgagttgttttagagctagaaatagcaagttaaaataaggctagtccgttatcaacttgaaaaagtggcaccgagtcggtgctttt

SEQ ID NO: 700 - DNA, 100 bp, Artificial Sequence
  source: /note="Description of Artificial Sequence: Synthetic polynucleotide"
aactgaacatcggtgagttagttttagagctagaaatagcaagttaaaataaggctagtccgttatcaacttgaaaaagtggcaccgagtcggtgctttt

SEQ ID NO: 701 - DNA, 100 bp, Artificial Sequence
  source: /note="Description of Artificial Sequence: Synthetic polynucleotide"
ggtgctaattacaactgctggttttagagctagaaatagcaagttaaaataaggctagtccgttatcaacttgaaaaagtggcaccgagtcggtgctttt

SEQ ID NO: 702 - DNA, 100 bp, Artificial Sequence
  source: /note="Description of Artificial Sequence: Synthetic polynucleotide"
gggtgctaattacaactgctgttttagagctagaaatagcaagttaaaataaggctagtccgttatcaacttgaaaaagtggcaccgagtcggtgctttt

SEQ ID NO: 703 - DNA, 100 bp, Artificial Sequence
  source: /note="Description of Artificial Sequence: Synthetic polynucleotide"
ggggtgctaattacaactgcgttttagagctagaaatagcaagttaaaataaggctagtccgttatcaacttgaaaaagtggcaccgagtcggtgctttt

SEQ ID NO: 704 - DNA, 100 bp, Artificial Sequence
  source: /note="Description of Artificial Sequence: Synthetic polynucleotide"
agcagttgtaattagcacccgttttagagctagaaatagcaagttaaaataaggctagtccgttatcaacttgaaaaagtggcaccgagtcggtgctttt

SEQ ID NO: 705 - DNA, 100 bp, Artificial Sequence
  source: /note="Description of Artificial Sequence: Synthetic polynucleotide"
gcagttgtaattagcaccccgttttagagctagaaatagcaagttaaaataaggctagtccgttatcaacttgaaaaagtggcaccgagtcggtgctttt

SEQ ID NO: 706 - DNA, 100 bp, Artificial Sequence
  source: /note="Description of Artificial Sequence: Synthetic polynucleotide"
tggtttctggctgacacccggttttagagctagaaatagcaagttaaaataaggctagtccgttatcaacttgaaaaagtggcaccgagtcggtgctttt

SEQ ID NO: 707 - DNA, 100 bp, Artificial Sequence
  source: /note="Description of Artificial Sequence: Synthetic polynucleotide"
ttggtttctggctgacacccgttttagagctagaaatagcaagttaaaataaggctagtccgttatcaacttgaaaaagtggcaccgagtcggtgctttt

SEQ ID NO: 708 - DNA, 100 bp, Artificial Sequence
  source: /note="Description of Artificial Sequence: Synthetic polynucleotide"
gttggtttctggctgacaccgttttagagctagaaatagcaagttaaaataaggctagtccgttatcaacttgaaaaagtggcaccgagtcggtgctttt

SEQ ID NO: 709 - DNA, 100 bp, Artificial Sequence
  source: /note="Description of Artificial Sequence: Synthetic polynucleotide"
tttggctgtttgttggtttcgttttagagctagaaatagcaagttaaaataaggctagtccgttatcaacttgaaaaagtggcaccgagtcggtgctttt

SEQ ID NO: 710 - DNA, 100 bp, Artificial Sequence
  source: /note="Description of Artificial Sequence: Synthetic polynucleotide"
gcagggatttggctgtttgtgttttagagctagaaatagcaagttaaaataaggctagtccgttatcaacttgaaaaagtggcaccgagtcggtgctttt

SEQ ID NO: 711 - DNA, 100 bp, Artificial Sequence
  source: /note="Description of Artificial Sequence: Synthetic polynucleotide"
tgggcggggctgcagggattgttttagagctagaaatagcaagttaaaataaggctagtccgttatcaacttgaaaaagtggcaccgagtcggtgctttt

SEQ ID NO: 712 - DNA, 100 bp, Artificial Sequence
  source: /note="Description of Artificial Sequence: Synthetic polynucleotide"
ataggctgggcggggctgcagttttagagctagaaatagcaagttaaaataaggctagtccgttatcaacttgaaaaagtggcaccgagtcggtgctttt

SEQ ID NO: 713 - DNA, 100 bp, Artificial Sequence
  source: /note="Description of Artificial Sequence: Synthetic polynucleotide"
gataggctgggcggggctgcgttttagagctagaaatagcaagttaaaataaggctagtccgttatcaacttgaaaaagtggcaccgagtcggtgctttt

SEQ ID NO: 714 - DNA, 100 bp, Artificial Sequence
  source: /note="Description of Artificial Sequence: Synthetic polynucleotide"
gccggtggataggctgggcggttttagagctagaaatagcaagttaaaataaggctagtccgttatcaacttgaaaaagtggcaccgagtcggtgctttt

SEQ ID NO: 715 - DNA, 100 bp, Artificial Sequence
  source: /note="Description of Artificial Sequence: Synthetic polynucleotide"
cgccggtggataggctgggcgttttagagctagaaatagcaagttaaaataaggctagtccgttatcaacttgaaaaagtggcaccgagtcggtgctttt

SEQ ID NO: 716 - DNA, 100 bp, Artificial Sequence
  source: /note="Description of Artificial Sequence: Synthetic polynucleotide"
ccgccggtggataggctggggttttagagctagaaatagcaagttaaaataaggctagtccgttatcaacttgaaaaagtggcaccgagtcggtgctttt

SEQ ID NO: 717 - DNA, 100 bp, Artificial Sequence
  source: /note="Description of Artificial Sequence: Synthetic polynucleotide"
cccccgccggtggataggctgttttagagctagaaatagcaagttaaaataaggctagtccgttatcaacttgaaaaagtggcaccgagtcggtgctttt

SEQ ID NO: 718 - DNA, 100 bp, Artificial Sequence
  source: /note="Description of Artificial Sequence: Synthetic polynucleotide"
tcccccgccggtggataggcgttttagagctagaaatagcaagttaaaataaggctagtccgttatcaacttgaaaaagtggcaccgagtcggtgctttt

SEQ ID NO: 719 - DNA, 100 bp, Artificial Sequence
  source: /note="Description of Artificial Sequence: Synthetic polynucleotide"
gccccgcccagcctatccacgttttagagctagaaatagcaagttaaaataaggctagtccgttatcaacttgaaaaagtggcaccgagtcggtgctttt

SEQ ID NO: 720 - DNA, 100 bp, Artificial Sequence
  source: /note="Description of Artificial Sequence: Synthetic polynucleotide"
tcggtcccccgccggtggatgttttagagctagaaatagcaagttaaaataaggctagtccgttatcaacttgaaaaagtggcaccgagtcggtgctttt

SEQ ID NO: 721 - DNA, 100 bp, Artificial Sequence
  source: /note="Description of Artificial Sequence: Synthetic polynucleotide"
ccgcccagcctatccaccgggttttagagctagaaatagcaagttaaaataaggctagtccgttatcaacttgaaaaagtggcaccgagtcggtgctttt

SEQ ID NO: 722 - DNA, 100 bp, Artificial Sequence
  source: /note="Description of Artificial Sequence: Synthetic polynucleotide"
cgcccagcctatccaccggcgttttagagctagaaatagcaagttaaaataaggctagtccgttatcaacttgaaaaagtggcaccgagtcggtgctttt

SEQ ID NO: 723 - DNA, 100 bp, Artificial Sequence
  source: /note="Description of Artificial Sequence: Synthetic polynucleotide"
gcccagcctatccaccggcggttttagagctagaaatagcaagttaaaataaggctagtccgttatcaacttgaaaaagtggcaccgagtcggtgctttt

SEQ ID NO: 724 - DNA, 100 bp, Artificial Sequence
  source: /note="Description of Artificial Sequence: Synthetic polynucleotide"
gttaatcggtcccccgccgggttttagagctagaaatagcaagttaaaataaggctagtccgttatcaacttgaaaaagtggcaccgagtcggtgctttt

SEQ ID NO: 725 - DNA, 100 bp, Artificial Sequence
  source: /note="Description of Artificial Sequence: Synthetic polynucleotide"
cccagcctatccaccggcgggttttagagctagaaatagcaagttaaaataaggctagtccgttatcaacttgaaaaagtggcaccgagtcggtgctttt

SEQ ID NO: 726 - DNA, 100 bp, Artificial Sequence
  source: /note="Description of Artificial Sequence: Synthetic polynucleotide"
atggttaatcggtcccccgcgttttagagctagaaatagcaagttaaaataaggctagtccgttatcaacttgaaaaagtggcaccgagtcggtgctttt

SEQ ID NO: 727 - DNA, 100 bp, Artificial Sequence
  source: /note="Description of Artificial Sequence: Synthetic polynucleotide"
ggtgggggttaatggttaatgttttagagctagaaatagcaagttaaaataaggctagtccgttatcaacttgaaaaagtggcaccgagtcggtgctttt

SEQ ID NO: 728 - DNA, 100 bp, Artificial Sequence
  source: /note="Description of Artificial Sequence: Synthetic polynucleotide"
cggggaggggtgggggttaagttttagagctagaaatagcaagttaaaataaggctagtccgttatcaacttgaaaaagtggcaccgagtcggtgctttt

SEQ ID NO: 729 - DNA, 100 bp, Artificial Sequence
  source: /note="Description of Artificial Sequence: Synthetic polynucleotide"
gctctgccggggaggggtgggttttagagctagaaatagcaagttaaaataaggctagtccgttatcaacttgaaaaagtggcaccgagtcggtgctttt

SEQ ID NO: 730 - DNA, 100 bp, Artificial Sequence
  source: /note="Description of Artificial Sequence: Synthetic polynucleotide"
ggctctgccggggaggggtggttttagagctagaaatagcaagttaaaataaggctagtccgttatcaacttgaaaaagtggcaccgagtcggtgctttt

SEQ ID NO: 731 - DNA, 100 bp, Artificial Sequence
  source: /note="Description of Artificial Sequence: Synthetic polynucleotide"
aggctctgccggggaggggtgttttagagctagaaatagcaagttaaaataaggctagtccgttatcaacttgaaaaagtggcaccgagtcggtgctttt

SEQ ID NO: 732 - DNA, 100 bp, Artificial Sequence
  source: /note="Description of Artificial Sequence: Synthetic polynucleotide"
gaggctctgccggggagggggttttagagctagaaatagcaagttaaaataaggctagtccgttatcaacttgaaaaagtggcaccgagtcggtgctttt

SEQ ID NO: 733 - DNA, 100 bp, Artificial Sequence
  source: /note="Description of Artificial Sequence: Synthetic polynucleotide"
cattaacccccacccctcccgttttagagctagaaatagcaagttaaaataaggctagtccgttatcaacttgaaaaagtggcaccgagtcggtgctttt

SEQ ID NO: 734 - DNA, 100 bp, Artificial Sequence
  source: /note="Description of Artificial Sequence: Synthetic polynucleotide"
gtggaggctctgccggggaggttttagagctagaaatagcaagttaaaataaggctagtccgttatcaacttgaaaaagtggcaccgagtcggtgctttt

SEQ ID NO: 735 - DNA, 100 bp, Artificial Sequence
  source: /note="Description of Artificial Sequence: Synthetic polynucleotide"
ggtggaggctctgccggggagttttagagctagaaatagcaagttaaaataaggctagtccgttatcaacttgaaaaagtggcaccgagtcggtgctttt

SEQ ID NO: 736 - DNA, 100 bp, Artificial Sequence
  source: /note="Description of Artificial Sequence: Synthetic polynucleotide"
gggtggaggctctgccgggggttttagagctagaaatagcaagttaaaataaggctagtccgttatcaacttgaaaaagtggcaccgagtcggtgctttt

SEQ ID NO: 737 - DNA, 100 bp, Artificial Sequence
  source: /note="Description of Artificial Sequence: Synthetic polynucleotide"
aaggggtggaggctctgccggttttagagctagaaatagcaagttaaaataaggctagtccgttatcaacttgaaaaagtggcaccgagtcggtgctttt

SEQ ID NO: 738 - DNA, 100 bp, Artificial Sequence
  source: /note="Description of Artificial Sequence: Synthetic polynucleotide"
gaaggggtggaggctctgccgttttagagctagaaatagcaagttaaaataaggctagtccgttatcaacttgaaaaagtggcaccgagtcggtgctttt

SEQ ID NO: 739 - DNA, 100 bp, Artificial Sequence
  source: /note="Description of Artificial Sequence: Synthetic polynucleotide"
tgaaggggtggaggctctgcgttttagagctagaaatagcaagttaaaataaggctagtccgttatcaacttgaaaaagtggcaccgagtcggtgctttt

SEQ ID NO: 740 - DNA, 100 bp, Artificial Sequence
  source: /note="Description of Artificial Sequence: Synthetic polynucleotide"
tagcctctgtgaaggggtgggttttagagctagaaatagcaagttaaaataaggctagtccgttatcaacttgaaaaagtggcaccgagtcggtgctttt

SEQ ID NO: 741 - DNA, 100 bp, Artificial Sequence
  source: /note="Description of Artificial Sequence: Synthetic polynucleotide"
gcctagcctctgtgaagggggttttagagctagaaatagcaagttaaaataaggctagtccgttatcaacttgaaaaagtggcaccgagtcggtgctttt

SEQ ID NO: 742 - DNA, 100 bp, Artificial Sequence
  source: /note="Description of Artificial Sequence: Synthetic polynucleotide"
ttggcctagcctctgtgaaggttttagagctagaaatagcaagttaaaataaggctagtccgttatcaacttgaaaaagtggcaccgagtcggtgctttt

SEQ ID NO: 743 - DNA, 100 bp, Artificial Sequence
  source: /note="Description of Artificial Sequence: Synthetic polynucleotide"
cttggcctagcctctgtgaagttttagagctagaaatagcaagttaaaataaggctagtccgttatcaacttgaaaaagtggcaccgagtcggtgctttt

SEQ ID NO: 744 - DNA, 100 bp, Artificial Sequence
  source: /note="Description of Artificial Sequence: Synthetic polynucleotide"
gagcctccaccccttcacaggttttagagctagaaatagcaagttaaaataaggctagtccgttatcaacttgaaaaagtggcaccgagtcggtgctttt

SEQ ID NO: 745 - DNA, 100 bp, Artificial Sequence
  source: /note="Description of Artificial Sequence: Synthetic polynucleotide"
tcttggcctagcctctgtgagttttagagctagaaatagcaagttaaaataaggctagtccgttatcaacttgaaaaagtggcaccgagtcggtgctttt

SEQ ID NO: 746 - DNA, 100 bp, Artificial Sequence
  source: /note="Description of Artificial Sequence: Synthetic polynucleotide"
tccaccccttcacagaggctgttttagagctagaaatagcaagttaaaataaggctagtccgttatcaacttgaaaaagtggcaccgagtcggtgctttt

SEQ ID NO: 747 - DNA, 100 bp, Artificial Sequence
  source: /note="Description of Artificial Sequence: Synthetic polynucleotide"
ggaagatctgctgggagtctgttttagagctagaaatagcaagttaaaataaggctagtccgttatcaacttgaaaaagtggcaccgagtcggtgctttt

SEQ ID NO: 748 - DNA, 100 bp, Artificial Sequence
  source: /note="Description of Artificial Sequence: Synthetic polynucleotide"
gtcctctgggaagatctgctgttttagagctagaaatagcaagttaaaataaggctagtccgttatcaacttgaaaaagtggcaccgagtcggtgctttt

SEQ ID NO: 749 - DNA, 100 bp, Artificial Sequence
  source: /note="Description of Artificial Sequence: Synthetic polynucleotide"
cgtcctctgggaagatctgcgttttagagctagaaatagcaagttaaaataaggctagtccgttatcaacttgaaaaagtggcaccgagtcggtgctttt

SEQ ID NO: 750 - DNA, 100 bp, Artificial Sequence
  source: /note="Description of Artificial Sequence: Synthetic polynucleotide"
ctcccagcagatcttcccaggttttagagctagaaatagcaagttaaaataaggctagtccgttatcaacttgaaaaagtggcaccgagtcggtgctttt

SEQ ID NO: 751 - DNA, 100 bp, Artificial Sequence
  source: /note="Description of Artificial Sequence: Synthetic polynucleotide"
cagcagatcttcccagaggagttttagagctagaaatagcaagttaaaataaggctagtccgttatcaacttgaaaaagtggcaccgagtcggtgctttt

SEQ ID NO: 752 - DNA, 100 bp, Artificial Sequence
  source: /note="Description of Artificial Sequence: Synthetic polynucleotide"
ttcctttcaaaccgtcctctgttttagagctagaaatagcaagttaaaataaggctagtccgttatcaacttgaaaaagtggcaccgagtcggtgctttt

SEQ ID NO: 753 - DNA, 100 bp, Artificial Sequence
  source: /note="Description of Artificial Sequence: Synthetic polynucleotide"
cttcctttcaaaccgtcctcgttttagagctagaaatagcaagttaaaataaggctagtccgttatcaacttgaaaaagtggcaccgagtcggtgctttt

SEQ ID NO: 754 - DNA, 100 bp, Artificial Sequence
  source: /note="Description of Artificial Sequence: Synthetic polynucleotide"
ttcccagaggacggtttgaagttttagagctagaaatagcaagttaaaataaggctagtccgttatcaacttgaaaaagtggcaccgagtcggtgctttt

SEQ ID NO: 755 - DNA, 100 bp, Artificial Sequence
  source: /note="Description of Artificial Sequence: Synthetic polynucleotide"
cagaggacggtttgaaaggagttttagagctagaaatagcaagttaaaataaggctagtccgttatcaacttgaaaaagtggcaccgagtcggtgctttt

SEQ ID NO: 756 - DNA, 100 bp, Artificial Sequence
  source: /note="Description of Artificial Sequence: Synthetic polynucleotide"
ggtttgaaaggaaggcagaggttttagagctagaaatagcaagttaaaataaggctagtccgttatcaacttgaaaaagtggcaccgagtcggtgctttt

SEQ ID NO: 757 - DNA, 100 bp, Artificial Sequence
  source: /note="Description of Artificial Sequence: Synthetic polynucleotide"
gtttgaaaggaaggcagagagttttagagctagaaatagcaagttaaaataaggctagtccgttatcaacttgaaaaagtggcaccgagtcggtgctttt

SEQ ID NO: 758 - DNA, 100 bp, Artificial Sequence
  source: /note="Description of Artificial Sequence: Synthetic polynucleotide"
aaggaaggcagagagggcacgttttagagctagaaatagcaagttaaaataaggctagtccgttatcaacttgaaaaagtggcaccgagtcggtgctttt

SEQ ID NO: 759 - DNA, 100 bp, Artificial Sequence
  source: /note="Description of Artificial Sequence: Synthetic polynucleotide"
aggaaggcagagagggcactgttttagagctagaaatagcaagttaaaataaggctagtccgttatcaacttgaaaaagtggcaccgagtcggtgctttt

SEQ ID NO: 760 - DNA, 100 bp, Artificial Sequence
  source: /note="Description of Artificial Sequence: Synthetic polynucleotide"
aaggcagagagggcactggggttttagagctagaaatagcaagttaaaataaggctagtccgttatcaacttgaaaaagtggcaccgagtcggtgctttt

SEQ ID NO: 761 - DNA, 100 bp, Artificial Sequence
  source: /note="Description of Artificial Sequence: Synthetic polynucleotide"
gcagagagggcactgggagggttttagagctagaaatagcaagttaaaataaggctagtccgttatcaacttgaaaaagtggcaccgagtcggtgctttt

SEQ ID NO: 762 - DNA, 100 bp, Artificial Sequence
  source: /note="Description of Artificial Sequence: Synthetic polynucleotide"
agggcactgggaggaggcaggttttagagctagaaatagcaagttaaaataaggctagtccgttatcaacttgaaaaagtggcaccgagtcggtgctttt

SEQ ID NO: 763 - DNA, 100 bp, Artificial Sequence
  source: /note="Description of Artificial Sequence: Synthetic polynucleotide"
gggcactgggaggaggcagtgttttagagctagaaatagcaagttaaaataaggctagtccgttatcaacttgaaaaagtggcaccgagtcggtgctttt

SEQ ID NO: 764 - DNA, 100 bp, Artificial Sequence
  source: /note="Description of Artificial Sequence: Synthetic polynucleotide"
cactgggaggaggcagtggggttttagagctagaaatagcaagttaaaataaggctagtccgttatcaacttgaaaaagtggcaccgagtcggtgctttt

SEQ ID NO: 765 - DNA, 100 bp, Artificial Sequence
  source: /note="Description of Artificial Sequence: Synthetic polynucleotide"
actgggaggaggcagtgggagttttagagctagaaatagcaagttaaaataaggctagtccgttatcaacttgaaaaagtggcaccgagtcggtgctttt

SEQ ID NO: 766 - DNA, 100 bp, Artificial Sequence
  source: /note="Description of Artificial Sequence: Synthetic polynucleotide"
gggaggaggcagtgggaggggttttagagctagaaatagcaagttaaaataaggctagtccgttatcaacttgaaaaagtggcaccgagtcggtgctttt

SEQ ID NO: 767 - DNA, 100 bp, Artificial Sequence
  source: /note="Description of Artificial Sequence: Synthetic polynucleotide"
aggaggcagtgggagggcgggttttagagctagaaatagcaagttaaaataaggctagtccgttatcaacttgaaaaagtggcaccgagtcggtgctttt

SEQ ID NO: 768 - DNA, 100 bp, Artificial Sequence
  source: /note="Description of Artificial Sequence: Synthetic polynucleotide"
ggaggcagtgggagggcggagttttagagctagaaatagcaagttaaaataaggctagtccgttatcaacttgaaaaagtggcaccgagtcggtgctttt

SEQ ID NO: 769 - DNA, 100 bp, Artificial Sequence
  source: /note="Description of Artificial Sequence: Synthetic polynucleotide"
ggcagtgggagggcggaggggttttagagctagaaatagcaagttaaaataaggctagtccgttatcaacttgaaaaagtggcaccgagtcggtgctttt

SEQ ID NO: 770 - DNA, 100 bp, Artificial Sequence
  source: /note="Description of Artificial Sequence: Synthetic polynucleotide"
gcagtgggagggcggagggcgttttagagctagaaatagcaagttaaaataaggctagtccgttatcaacttgaaaaagtggcaccgagtcggtgctttt

SEQ ID NO: 771 - DNA, 100 bp, Artificial Sequence
  source: /note="Description of Artificial Sequence: Synthetic polynucleotide"
cagtgggagggcggagggcggttttagagctagaaatagcaagttaaaataaggctagtccgttatcaacttgaaaaagtggcaccgagtcggtgctttt

SEQ ID NO: 772 - DNA, 100 bp, Artificial Sequence
  source: /note="Description of Artificial Sequence: Synthetic polynucleotide"
agtgggagggcggagggcgggttttagagctagaaatagcaagttaaaataaggctagtccgttatcaacttgaaaaagtggcaccgagtcggtgctttt

SEQ ID NO: 773 - DNA, 100 bp, Artificial Sequence
  source: /note="Description of Artificial Sequence: Synthetic polynucleotide"
gggcggagggcgggggccttgttttagagctagaaatagcaagttaaaataaggctagtccgttatcaacttgaaaaagtggcaccgagtcggtgctttt

SEQ ID NO: 774 - DNA, 100 bp, Artificial Sequence
  source: /note="Description of Artificial Sequence: Synthetic polynucleotide"
ggcggagggcgggggccttcgttttagagctagaaatagcaagttaaaataaggctagtccgttatcaacttgaaaaagtggcaccgagtcggtgctttt

SEQ ID NO: 775 - DNA, 100 bp, Artificial Sequence
  source: /note="Description of Artificial Sequence: Synthetic polynucleotide"
gcggagggcgggggccttcggttttagagctagaaatagcaagttaaaataaggctagtccgttatcaacttgaaaaagtggcaccgagtcggtgctttt

SEQ ID NO: 776 - DNA, 100 bp, Artificial Sequence
  source: /note="Description of Artificial Sequence: Synthetic polynucleotide"
gagggcgggggccttcgggggttttagagctagaaatagcaagttaaaataaggctagtccgttatcaacttgaaaaagtggcaccgagtcggtgctttt

SEQ ID NO: 777 - DNA, 100 bp, Artificial Sequence
  source: /note="Description of Artificial Sequence: Synthetic polynucleotide"
accctgggcgcccaccccgagttttagagctagaaatagcaagttaaaataaggctagtccgttatcaacttgaaaaagtggcaccgagtcggtgctttt

SEQ ID NO: 778 - DNA, 100 bp, Artificial Sequence
  source: /note="Description of Artificial Sequence: Synthetic polynucleotide"
agggcgggggccttcggggtgttttagagctagaaatagcaagttaaaataaggctagtccgttatcaacttgaaaaagtggcaccgagtcggtgctttt

SEQ ID NO: 779 - DNA, 100 bp, Artificial Sequence
  source: /note="Description of Artificial Sequence: Synthetic polynucleotide"
ggccttcggggtgggcgcccgttttagagctagaaatagcaagttaaaataaggctagtccgttatcaacttgaaaaagtggcaccgagtcggtgctttt

SEQ ID NO: 780 - DNA, 100 bp, Artificial Sequence
  source: /note="Description of Artificial Sequence: Synthetic polynucleotide"
gccttcggggtgggcgcccagttttagagctagaaatagcaagttaaaataaggctagtccgttatcaacttgaaaaagtggcaccgagtcggtgctttt

SEQ ID NO: 781 - DNA, 100 bp, Artificial Sequence
  source: /note="Description of Artificial Sequence: Synthetic polynucleotide"
tcggggtgggcgcccagggtgttttagagctagaaatagcaagttaaaataaggctagtccgttatcaacttgaaaaagtggcaccgagtcggtgctttt

SEQ ID NO: 782 - DNA, 100 bp, Artificial Sequence
  source: /note="Description of Artificial Sequence: Synthetic polynucleotide"
cggggtgggcgcccagggtagttttagagctagaaatagcaagttaaaataaggctagtccgttatcaacttgaaaaagtggcaccgagtcggtgctttt

SEQ ID NO: 783 - DNA, 100 bp, Artificial Sequence
  source: /note="Description of Artificial Sequence: Synthetic polynucleotide"
gcggccacctgccctaccctgttttagagctagaaatagcaagttaaaataaggctagtccgttatcaacttgaaaaagtggcaccgagtcggtgctttt

SEQ ID NO: 784 - DNA, 100 bp, Artificial Sequence
  source: /note="Description of Artificial Sequence: Synthetic polynucleotide"
cgcggccacctgccctacccgttttagagctagaaatagcaagttaaaataaggctagtccgttatcaacttgaaaaagtggcaccgagtcggtgctttt

SEQ ID NO: 785 - DNA, 100 bp, Artificial Sequence
  source: /note="Description of Artificial Sequence: Synthetic polynucleotide"
gtgggcgcccagggtagggcgttttagagctagaaatagcaagttaaaataaggctagtccgttatcaacttgaaaaagtggcaccgagtcggtgctttt

SEQ ID NO: 786 - DNA, 100 bp, Artificial Sequence
  source: /note="Description of Artificial Sequence: Synthetic polynucleotide"
ggcgcccagggtagggcagggttttagagctagaaatagcaagttaaaataaggctagtccgttatcaacttgaaaaagtggcaccgagtcggtgctttt

SEQ ID NO: 787 - DNA, 100 bp, Artificial Sequence
  source: /note="Description of Artificial Sequence: Synthetic polynucleotide"
cagggtagggcaggtggccggttttagagctagaaatagcaagttaaaataaggctagtccgttatcaacttgaaaaagtggcaccgagtcggtgctttt

SEQ ID NO: 788 - DNA, 100 bp, Artificial Sequence
  source: /note="Description of Artificial Sequence: Synthetic polynucleotide"
tagggcaggtggccgcggcggttttagagctagaaatagcaagttaaaataaggctagtccgttatcaacttgaaaaagtggcaccgagtcggtgctttt

SEQ ID NO: 789 - DNA, 100 bp, Artificial Sequence
  source: /note="Description of Artificial Sequence: Synthetic polynucleotide"
ttctccctgcctccacgccggttttagagctagaaatagcaagttaaaataaggctagtccgttatcaacttgaaaaagtggcaccgagtcggtgctttt

SEQ ID NO: 790 - DNA, 100 bp, Artificial Sequence
  source: /note="Description of Artificial Sequence: Synthetic polynucleotide"
ggcaggtggccgcggcgtgggttttagagctagaaatagcaagttaaaataaggctagtccgttatcaacttgaaaaagtggcaccgagtcggtgctttt

SEQ ID NO: 791 - DNA, 100 bp, Artificial Sequence
  source: /note="Description of Artificial Sequence: Synthetic polynucleotide"
ggtggccgcggcgtggaggcgttttagagctagaaatagcaagttaaaataaggctagtccgttatcaacttgaaaaagtggcaccgagtcggtgctttt

SEQ ID NO: 792 - DNA, 100 bp, Artificial Sequence
  source: /note="Description of Artificial Sequence: Synthetic polynucleotide"
gtggccgcggcgtggaggcagttttagagctagaaatagcaagttaaaataaggctagtccgttatcaacttgaaaaagtggcaccgagtcggtgctttt

SEQ ID NO: 793 - DNA, 100 bp, Artificial Sequence
  source: /note="Description of Artificial Sequence: Synthetic polynucleotide"
gtccatgtcgacgagggtttgttttagagctagaaatagcaagttaaaataaggctagtccgttatcaacttgaaaaagtggcaccgagtcggtgctttt

SEQ ID NO: 794 - DNA, 100 bp, Artificial Sequence
  source: /note="Description of Artificial Sequence: Synthetic polynucleotide"
ggccatgtccatgtcgacgagttttagagctagaaatagcaagttaaaataaggctagtccgttatcaacttgaaaaagtggcaccgagtcggtgctttt

SEQ ID NO: 795 - DNA, 100 bp, Artificial Sequence
  source: /note="Description of Artificial Sequence: Synthetic polynucleotide"
cggccatgtccatgtcgacggttttagagctagaaatagcaagttaaaataaggctagtccgttatcaacttgaaaaagtggcaccgagtcggtgctttt

SEQ ID NO: 796 - DNA, 100 bp, Artificial Sequence
  source: /note="Description of Artificial Sequence: Synthetic polynucleotide"
ctccaaaaccctcgtcgacagttttagagctagaaatagcaagttaaaataaggctagtccgttatcaacttgaaaaagtggcaccgagtcggtgctttt

SEQ ID NO: 797 - DNA, 100 bp, Artificial Sequence
  source: /note="Description of Artificial Sequence: Synthetic polynucleotide"
aaccctcgtcgacatggacagttttagagctagaaatagcaagttaaaataaggctagtccgttatcaacttgaaaaagtggcaccgagtcggtgctttt

SEQ ID NO: 798 - DNA, 100 bp, Artificial Sequence
  source: /note="Description of Artificial Sequence: Synthetic polynucleotide"
gtccagtgcagcactgtagtgttttagagctagaaatagcaagttaaaataaggctagtccgttatcaacttgaaaaagtggcaccgagtcggtgctttt

SEQ ID NO: 799 - DNA, 100 bp, Artificial Sequence
  source: /note="Description of Artificial Sequence: Synthetic polynucleotide"
ggccgactacagtgctgcacgttttagagctagaaatagcaagttaaaataaggctagtccgttatcaacttgaaaaagtggcaccgagtcggtgctttt

SEQ ID NO: 800 - DNA, 100 bp, Artificial Sequence
  source: /note="Description of Artificial Sequence: Synthetic polynucleotide"
attccagggtggtgtaggctgttttagagctagaaatagcaagttaaaataaggctagtccgttatcaacttgaaaaagtggcaccgagtcggtgctttt

SEQ ID NO: 801 - DNA, 100 bp, Artificial Sequence
  source: /note="Description of Artificial Sequence: Synthetic polynucleotide"
aattccagggtggtgtaggcgttttagagctagaaatagcaagttaaaataaggctagtccgttatcaacttgaaaaagtggcaccgagtcggtgctttt

SEQ ID NO: 802 - DNA, 100 bp, Artificial Sequence
  source: /note="Description of Artificial Sequence: Synthetic polynucleotide"
ctcaaattccagggtggtgtgttttagagctagaaatagcaagttaaaataaggctagtccgttatcaacttgaaaaagtggcaccgagtcggtgctttt

SEQ ID NO: 803 - DNA, 100 bp, Artificial Sequence
  source: /note="Description of Artificial Sequence: Synthetic polynucleotide"
ggacccagcctacaccacccgttttagagctagaaatagcaagttaaaataaggctagtccgttatcaacttgaaaaagtggcaccgagtcggtgctttt

SEQ ID NO: 804 - DNA, 100 bp, Artificial Sequence
  source: /note="Description of Artificial Sequence: Synthetic polynucleotide"
cacattctcaaattccaggggttttagagctagaaatagcaagttaaaataaggctagtccgttatcaacttgaaaaagtggcaccgagtcggtgctttt

SEQ ID NO: 805 - DNA, 100 bp, Artificial Sequence
  source: /note="Description of Artificial Sequence: Synthetic polynucleotide"
ctgcacattctcaaattccagttttagagctagaaatagcaagttaaaataaggctagtccgttatcaacttgaaaaagtggcaccgagtcggtgctttt

SEQ ID NO: 806 - DNA, 100 bp, Artificial Sequence
  source: /note="Description of Artificial Sequence: Synthetic polynucleotide"
cctgcacattctcaaattccgttttagagctagaaatagcaagttaaaataaggctagtccgttatcaacttgaaaaagtggcaccgagtcggtgctttt

SEQ ID NO: 807 - DNA, 100 bp, Artificial Sequence
  source: /note="Description of Artificial Sequence: Synthetic polynucleotide"
cctggaatttgagaatgtgcgttttagagctagaaatagcaagttaaaataaggctagtccgttatcaacttgaaaaagtggcaccgagtcggtgctttt

SEQ ID NO: 808 - DNA, 100 bp, Artificial Sequence
  source: /note="Description of Artificial Sequence: Synthetic polynucleotide"
gaatgtgcaggtgttgacgagttttagagctagaaatagcaagttaaaataaggctagtccgttatcaacttgaaaaagtggcaccgagtcggtgctttt

SEQ ID NO: 809 - DNA, 100 bp, Artificial Sequence
  source: /note="Description of Artificial Sequence: Synthetic polynucleotide"
aatgtgcaggtgttgacgatgttttagagctagaaatagcaagttaaaataaggctagtccgttatcaacttgaaaaagtggcaccgagtcggtgctttt

SEQ ID NO: 810 - DNA, 100 bp, Artificial Sequence
  source: /note="Description of Artificial Sequence: Synthetic polynucleotide"
caggtgttgacgatgggcaagttttagagctagaaatagcaagttaaaataaggctagtccgttatcaacttgaaaaagtggcaccgagtcggtgctttt

SEQ ID NO: 811 - DNA, 100 bp, Artificial Sequence
  source: /note="Description of Artificial Sequence: Synthetic polynucleotide"
tgttgacgatgggcaatggtgttttagagctagaaatagcaagttaaaataaggctagtccgttatcaacttgaaaaagtggcaccgagtcggtgctttt

SEQ ID NO: 812 - DNA, 100 bp, Artificial Sequence
  source: /note="Description of Artificial Sequence: Synthetic polynucleotide"
tgacgatgggcaatggtagggttttagagctagaaatagcaagttaaaataaggctagtccgttatcaacttgaaaaagtggcaccgagtcggtgctttt

SEQ ID NO: 813 - DNA, 100 bp, Artificial Sequence
  source: /note="Description of Artificial Sequence: Synthetic polynucleotide"
gacgatgggcaatggtaggtgttttagagctagaaatagcaagttaaaataaggctagtccgttatcaacttgaaaaagtggcaccgagtcggtgctttt

SEQ ID NO: 814 - DNA, 100 bp, Artificial Sequence
  source: /note="Description of Artificial Sequence: Synthetic polynucleotide"
acgatgggcaatggtaggtggttttagagctagaaatagcaagttaaaataaggctagtccgttatcaacttgaaaaagtggcaccgagtcggtgctttt

SEQ ID NO: 815 - DNA, 100 bp, Artificial Sequence
  source: /note="Description of Artificial Sequence: Synthetic polynucleotide"
cgatgggcaatggtaggtgggttttagagctagaaatagcaagttaaaataaggctagtccgttatcaacttgaaaaagtggcaccgagtcggtgctttt

SEQ ID NO: 816 - DNA, 100 bp, Artificial Sequence
  source: /note="Description of Artificial Sequence: Synthetic polynucleotide"
aggtgggggcagatgtgcccgttttagagctagaaatagcaagttaaaataaggctagtccgttatcaacttgaaaaagtggcaccgagtcggtgctttt

SEQ ID NO: 817 - DNA, 100 bp, Artificial Sequence
  source: /note="Description of Artificial Sequence: Synthetic polynucleotide"
ctgcccccactggcacacctgttttagagctagaaatagcaagttaaaataaggctagtccgttatcaacttgaaaaagtggcaccgagtcggtgctttt

SEQ ID NO: 818 - DNA, 100 bp, Artificial Sequence
  source: /note="Description of Artificial Sequence: Synthetic polynucleotide"
cctgcccccactggcacaccgttttagagctagaaatagcaagttaaaataaggctagtccgttatcaacttgaaaaagtggcaccgagtcggtgctttt

SEQ ID NO: 819 - DNA, 100 bp, Artificial Sequence
  source: /note="Description of Artificial Sequence: Synthetic polynucleotide"
gatgtgcccaggtgtgccaggttttagagctagaaatagcaagttaaaataaggctagtccgttatcaacttgaaaaagtggcaccgagtcggtgctttt

SEQ ID NO: 820 - DNA, 100 bp, Artificial Sequence
  source: /note="Description of Artificial Sequence: Synthetic polynucleotide"
atgtgcccaggtgtgccagtgttttagagctagaaatagcaagttaaaataaggctagtccgttatcaacttgaaaaagtggcaccgagtcggtgctttt

SEQ ID NO: 821 - DNA, 100 bp, Artificial Sequence
  source: /note="Description of Artificial Sequence: Synthetic polynucleotide"
tgtgcccaggtgtgccagtggttttagagctagaaatagcaagttaaaataaggctagtccgttatcaacttgaaaaagtggcaccgagtcggtgctttt

SEQ ID NO: 822 - DNA, 100 bp, Artificial Sequence
  source: /note="Description of Artificial Sequence: Synthetic polynucleotide"
gtgcccaggtgtgccagtgggttttagagctagaaatagcaagttaaaataaggctagtccgttatcaacttgaaaaagtggcaccgagtcggtgctttt

SEQ ID NO: 823 - DNA, 100 bp, Artificial Sequence
  source: /note="Description of Artificial Sequence: Synthetic polynucleotide"
ccaggcacacctgcccccacgttttagagctagaaatagcaagttaaaataaggctagtccgttatcaacttgaaaaagtggcaccgagtcggtgctttt

SEQ ID NO: 824 - DNA, 100 bp, Artificial Sequence
  source: /note="Description of Artificial Sequence: Synthetic polynucleotide"
ccaggtgtgccagtgggggcgttttagagctagaaatagcaagttaaaataaggctagtccgttatcaacttgaaaaagtggcaccgagtcggtgctttt

SEQ ID NO: 825 - DNA, 100 bp, Artificial Sequence
  source: /note="Description of Artificial Sequence: Synthetic polynucleotide"
ccagtgggggcaggtgtgccgttttagagctagaaatagcaagttaaaataaggctagtccgttatcaacttgaaaaagtggcaccgagtcggtgctttt

SEQ ID NO: 826 - DNA, 100 bp, Artificial Sequence
  source: /note="Description of Artificial Sequence: Synthetic polynucleotide"
cagtgggggcaggtgtgcctgttttagagctagaaatagcaagttaaaataaggctagtccgttatcaacttgaaaaagtggcaccgagtcggtgctttt

SEQ ID NO: 827 - DNA, 100 bp, Artificial Sequence
  source: /note="Description of Artificial Sequence: Synthetic polynucleotide"
gggcaggtgtgcctgggtccgttttagagctagaaatagcaagttaaaataaggctagtccgttatcaacttgaaaaagtggcaccgagtcggtgctttt

SEQ ID NO: 828 - DNA, 100 bp, Artificial Sequence
  source: /note="Description of Artificial Sequence: Synthetic polynucleotide"
aaagatctgctcctggacccgttttagagctagaaatagcaagttaaaataaggctagtccgttatcaacttgaaaaagtggcaccgagtcggtgctttt

SEQ ID NO: 829 - DNA, 100 bp, Artificial Sequence
  source: /note="Description of Artificial Sequence: Synthetic polynucleotide"
gagtgccaaagatctgctccgttttagagctagaaatagcaagttaaaataaggctagtccgttatcaacttgaaaaagtggcaccgagtcggtgctttt

SEQ ID NO: 830 - DNA, 100 bp, Artificial Sequence
  source: /note="Description of Artificial Sequence: Synthetic polynucleotide"
tgggtccaggagcagatcttgttttagagctagaaatagcaagttaaaataaggctagtccgttatcaacttgaaaaagtggcaccgagtcggtgctttt

SEQ ID NO: 831 - DNA, 100 bp, Artificial Sequence
  source: /note="Description of Artificial Sequence: Synthetic polynucleotide"
agatctttggcactcaacttgttttagagctagaaatagcaagttaaaataaggctagtccgttatcaacttgaaaaagtggcaccgagtcggtgctttt

SEQ ID NO: 832 - DNA, 100 bp, Artificial Sequence
  source: /note="Description of Artificial Sequence: Synthetic polynucleotide"
gatctttggcactcaactttgttttagagctagaaatagcaagttaaaataaggctagtccgttatcaacttgaaaaagtggcaccgagtcggtgctttt

SEQ ID NO: 833 - DNA, 100 bp, Artificial Sequence
  source: /note="Description of Artificial Sequence: Synthetic polynucleotide"
atctttggcactcaactttggttttagagctagaaatagcaagttaaaataaggctagtccgttatcaacttgaaaaagtggcaccgagtcggtgctttt

SEQ ID NO: 834 - DNA, 100 bp, Artificial Sequence
  source: /note="Description of Artificial Sequence: Synthetic polynucleotide"
tttggcactcaactttgggggttttagagctagaaatagcaagttaaaataaggctagtccgttatcaacttgaaaaagtggcaccgagtcggtgctttt

SEQ ID NO: 835 - DNA, 100 bp, Artificial Sequence
  source: /note="Description of Artificial Sequence: Synthetic polynucleotide"
ttggcactcaactttggggtgttttagagctagaaatagcaagttaaaataaggctagtccgttatcaacttgaaaaagtggcaccgagtcggtgctttt

SEQ ID NO: 836 - DNA, 100 bp, Artificial Sequence
  source: /note="Description of Artificial Sequence: Synthetic polynucleotide"
gcactcaactttggggtggggttttagagctagaaatagcaagttaaaataaggctagtccgttatcaacttgaaaaagtggcaccgagtcggtgctttt

SEQ ID NO: 837 - DNA, 100 bp, Artificial Sequence
  source: /note="Description of Artificial Sequence: Synthetic polynucleotide"
gggaggagaatgatacaaaagttttagagctagaaatagcaagttaaaataaggctagtccgttatcaacttgaaaaagtggcaccgagtcggtgctttt

SEQ ID NO: 838 - DNA, 100 bp, Artificial Sequence
  source: /note="Description of Artificial Sequence: Synthetic polynucleotide"
ggagaatgatacaaaatggtgttttagagctagaaatagcaagttaaaataaggctagtccgttatcaacttgaaaaagtggcaccgagtcggtgctttt

SEQ ID NO: 839 - DNA, 100 bp, Artificial Sequence
  source: /note="Description of Artificial Sequence: Synthetic polynucleotide"
aatgatacaaaatggtaggtgttttagagctagaaatagcaagttaaaataaggctagtccgttatcaacttgaaaaagtggcaccgagtcggtgctttt

SEQ ID NO: 840 - DNA, 100 bp, Artificial Sequence
  source: /note="Description of Artificial Sequence: Synthetic polynucleotide"
aaatggtaggttggtcctacgttttagagctagaaatagcaagttaaaataaggctagtccgttatcaacttgaaaaagtggcaccgagtcggtgctttt

SEQ ID NO: 841 - DNA, 100 bp, Artificial Sequence
  source: /note="Description of Artificial Sequence: Synthetic polynucleotide"
caacacctgtgctggcctgtgttttagagctagaaatagcaagttaaaataaggctagtccgttatcaacttgaaaaagtggcaccgagtcggtgctttt

SEQ ID NO: 842 - DNA, 100 bp, Artificial Sequence
  source: /note="Description of Artificial Sequence: Synthetic polynucleotide"
ttggtcctacaggccagcacgttttagagctagaaatagcaagttaaaataaggctagtccgttatcaacttgaaaaagtggcaccgagtcggtgctttt

SEQ ID NO: 843 - DNA, 100 bp, Artificial Sequence
  source: /note="Description of Artificial Sequence: Synthetic polynucleotide"
tcacttggcaacacctgtgcgttttagagctagaaatagcaagttaaaataaggctagtccgttatcaacttgaaaaagtggcaccgagtcggtgctttt

SEQ ID NO: 844 - DNA, 100 bp, Artificial Sequence
  source: /note="Description of Artificial Sequence: Synthetic polynucleotide"
ctgggcacatgggcttcactgttttagagctagaaatagcaagttaaaataaggctagtccgttatcaacttgaaaaagtggcaccgagtcggtgctttt

SEQ ID NO: 845 - DNA, 100 bp, Artificial Sequence
  source: /note="Description of Artificial Sequence: Synthetic polynucleotide"
atcactgtgcctgggcacatgttttagagctagaaatagcaagttaaaataaggctagtccgttatcaacttgaaaaagtggcaccgagtcggtgctttt

SEQ ID NO: 846 - DNA, 100 bp, Artificial Sequence
  source: /note="Description of Artificial Sequence: Synthetic polynucleotide"
gatcactgtgcctgggcacagttttagagctagaaatagcaagttaaaataaggctagtccgttatcaacttgaaaaagtggcaccgagtcggtgctttt

SEQ ID NO: 847 - DNA, 100 bp, Artificial Sequence
  source: /note="Description of Artificial Sequence: Synthetic polynucleotide"
caagtgaagcccatgtgcccgttttagagctagaaatagcaagttaaaataaggctagtccgttatcaacttgaaaaagtggcaccgagtcggtgctttt

SEQ ID NO: 848 - DNA, 100 bp, Artificial Sequence
  source: /note="Description of Artificial Sequence: Synthetic polynucleotide"
tgcctgtgatcactgtgcctgttttagagctagaaatagcaagttaaaataaggctagtccgttatcaacttgaaaaagtggcaccgagtcggtgctttt

SEQ ID NO: 849 - DNA, 100 bp, Artificial Sequence
  source: /note="Description of Artificial Sequence: Synthetic polynucleotide"
atgcctgtgatcactgtgccgttttagagctagaaatagcaagttaaaataaggctagtccgttatcaacttgaaaaagtggcaccgagtcggtgctttt

SEQ ID NO: 850 - DNA, 100 bp, Artificial Sequence
  source: /note="Description of Artificial Sequence: Synthetic polynucleotide"
tgcccaggcacagtgatcacgttttagagctagaaatagcaagttaaaataaggctagtccgttatcaacttgaaaaagtggcaccgagtcggtgctttt

SEQ ID NO: 851 - DNA, 100 bp, Artificial Sequence
  source: /note="Description of Artificial Sequence: Synthetic polynucleotide"
cacagtgatcacaggcattcgttttagagctagaaatagcaagttaaaataaggctagtccgttatcaacttgaaaaagtggcaccgagtcggtgctttt

SEQ ID NO: 852 - DNA, 100 bp, Artificial Sequence
  source: /note="Description of Artificial Sequence: Synthetic polynucleotide"
acagtgatcacaggcattctgttttagagctagaaatagcaagttaaaataaggctagtccgttatcaacttgaaaaagtggcaccgagtcggtgctttt

SEQ ID NO: 853 - DNA, 100 bp, Artificial Sequence
  source: /note="Description of Artificial Sequence: Synthetic polynucleotide"
atcacaggcattctgggtgagttttagagctagaaatagcaagttaaaataaggctagtccgttatcaacttgaaaaagtggcaccgagtcggtgctttt

SEQ ID NO: 854 - DNA, 100 bp, Artificial Sequence
  source: /note="Description of Artificial Sequence: Synthetic polynucleotide"
tcacaggcattctgggtgaagttttagagctagaaatagcaagttaaaataaggctagtccgttatcaacttgaaaaagtggcaccgagtcggtgctttt

SEQ ID NO: 855 - DNA, 100 bp, Artificial Sequence
  source: /note="Description of Artificial Sequence: Synthetic polynucleotide"
caggcattctgggtgaaggggttttagagctagaaatagcaagttaaaataaggctagtccgttatcaacttgaaaaagtggcaccgagtcggtgctttt

SEQ ID NO: 856 - DNA, 100 bp, Artificial Sequence
  source: /note="Description of Artificial Sequence: Synthetic polynucleotide"
tgggtgaagggaggcctgcagttttagagctagaaatagcaagttaaaataaggctagtccgttatcaacttgaaaaagtggcaccgagtcggtgctttt

SEQ ID NO: 857 - DNA, 100 bp, Artificial Sequence
  source: /note="Description of Artificial Sequence: Synthetic polynucleotide"
gggtgaagggaggcctgcaagttttagagctagaaatagcaagttaaaataaggctagtccgttatcaacttgaaaaagtggcaccgagtcggtgctttt

SEQ ID NO: 858 - DNA, 100 bp, Artificial Sequence
  source: /note="Description of Artificial Sequence: Synthetic polynucleotide"
tgctggaaattggcccttgcgttttagagctagaaatagcaagttaaaataaggctagtccgttatcaacttgaaaaagtggcaccgagtcggtgctttt

SEQ ID NO: 859 - DNA, 1176 bp, Homo sapiens
ctccgggagggggtgggggtgagggaaacaggagaatgtgatgggaaaatccgagatggagccagcctgggccagaaacactgggagctgtgggagacggagaggggcagggtgggatcacagggagcaggagcggggaattggaggtgaatctggccctcccaaacttccagtccattctgctcccaggggaaccgggaaactgcgggggaactggaagggagctcccagaacaaggatccagaagattggcatctggggcctgggatttaggtttctaaatcgtgggccatggggcagccttatctctgcaaaagcattgagggtagaagtcaatgatttgggaagttattgaattaggggatctcggaggtaggctgtcagtgcctgatagtatcagttagaatgcctgacttggggtgacaatggcttggaggggtgggtgagtcaagggtcaaatgagtgcccgtgagtcatgatgcctgccttgtacaattgataactgaacatcggtgagttagggccccagcagttgtaattagcaccccgggtgtcagccagaaaccaacaaacagccaaatccctgcagccccgcccagcctatccaccggcgggggaccgattaaccattaacccccacccctccccggcagagcctccaccccttcacagaggctaggccaagactcccagcagatcttcccagaggacggtttgaaaggaaggcagagagggcactgggaggaggcagtgggagggcggagggcgggggccttcggggtgggcgcccagggtagggcaggtggccgcggcgtggaggcagggagaatgcgactctccaaaaccctcgtcgacatggacatggccgactacagtgctgcactggacccagcctacaccaccctggaatttgagaatgtgcaggtgttgacgatgggcaatggtaggtgggggcagatgtgcccaggtgtgccagtgggggcaggtgtgcctgggtccaggagcagatctttggcactcaactttggggtgggaggagaatgatacaaaatggtaggttggtcctacaggccagcacaggtgttgccaagtgaagcccatgtgcccaggcacagtgatcacaggcattctgggtgaagggaggcctgcaagggccaatttccagcaaaagtcgat

SEQ ID NO: 860 - DNA, 1176 bp, Homo sapiens
atcgacttttgctggaaattggcccttgcaggcctcccttcacccagaatgcctgtgatcactgtgcctgggcacatgggcttcacttggcaacacctgtgctggcctgtaggaccaacctaccattttgtatcattctcctcccaccccaaagttgagtgccaaagatctgctcctggacccaggcacacctgcccccactggcacacctgggcacatctgcccccacctaccattgcccatcgtcaacacctgcacattctcaaattccagggtggtgtaggctgggtccagtgcagcactgtagtcggccatgtccatgtcgacgagggttttggagagtcgcattctccctgcctccacgccgcggccacctgccctaccctgggcgcccaccccgaaggcccccgccctccgccctcccactgcctcctcccagtgccctctctgccttcctttcaaaccgtcctctgggaagatctgctgggagtcttggcctagcctctgtgaaggggtggaggctctgccggggaggggtgggggttaatggttaatcggtcccccgccggtggataggctgggcggggctgcagggatttggctgtttgttggtttctggctgacacccggggtgctaattacaactgctggggccctaactcaccgatgttcagttatcaattgtacaaggcaggcatcatgactcacgggcactcatttgacccttgactcacccacccctccaagccattgtcaccccaagtcaggcattctaactgatactatcaggcactgacagcctacctccgagatcccctaattcaataacttcccaaatcattgacttctaccctcaatgcttttgcagagataaggctgccccatggcccacgatttagaaacctaaatcccaggccccagatgccaatcttctggatccttgttctgggagctcccttccagttcccccgcagtttcccggttcccctgggagcagaatggactggaagtttgggagggccagattcacctccaattccccgctcctgctccctgtgatcccaccctgcccctctccgtctcccacagctcccagtgtttctggcccaggctggctccatctcggattttcccatcacattctcctgtttccctcacccccaccccctcccggag

SEQ ID NO: 861 - DNA, 21 bp, Homo sapiens
agatggagccagcctgggcca

SEQ ID NO: 862 - DNA, 21 bp, Homo sapiens
cagcctgggccagaaacactg

SEQ ID NO: 863 - DNA, 21 bp, Homo sapiens
agccagcctgggccagaaaca

SEQ ID NO: 864 - DNA, 21 bp, Homo sapiens
tggagccagcctgggccagaa

SEQ ID NO: 865 - DNA, 21 bp, Homo sapiens
ccgagatggagccagcctggg

SEQ ID NO: 866 - DNA, 21 bp, Homo sapiens
aatccgagatggagccagcct

SEQ ID NO: 867 - DNA, 21 bp, Homo sapiens
aggagaatgtgatgggaaaat

SEQ ID NO: 868 - DNA, 21 bp, Homo sapiens
aacaggagaatgtgatgggaa

SEQ ID NO: 869 - DNA, 21 bp, Homo sapiens
tgatgggaaaatccgagatgg

SEQ ID NO: 870 - DNA, 21 bp, Homo sapiens
gaaaatccgagatggagccag

SEQ ID NO: 871 - DNA, 21 bp, Homo sapiens
tgggaaaatccgagatggagc

SEQ ID NO: 872 - DNA, 21 bp, Homo sapiens
cctgggccagaaacactggga

SEQ ID NO: 873 - DNA, 21 bp, Homo sapiens
ccagaaacactgggagctgtg

SEQ ID NO: 874 - DNA, 21 bp, Homo sapiens
gggccagaaacactgggagct

SEQ ID NO: 875 - DNA, 21 bp, Homo sapiens
gagggaaacaggagaatgtga

SEQ ID NO: 876 - DNA, 21 bp, Homo sapiens
ggaaacaggagaatgtgatgg

SEQ ID NO: 877 - DNA, 21 bp, Homo sapiens
atgtgatgggaaaatccgaga

SEQ ID NO: 878 - DNA, 21 bp, Homo sapiens
agaatgtgatgggaaaatccg

SEQ ID NO: 879 - DNA, 21 bp, Homo sapiens
gaaacactgggagctgtggga

SEQ ID NO: 880 - DNA, 21 bp, Homo sapiens
gtgggagacggagaggggcag

SEQ ID NO: 881 - DNA, 21 bp, Homo sapiens
acactgggagctgtgggagac

SEQ ID NO: 882 - DNA, 21 bp, Homo sapiens
gctgtgggagacggagagggg

SEQ ID NO: 883 - DNA, 21 bp, Homo sapiens
ctgggagctgtgggagacgga

SEQ ID NO: 884 - DNA, 21 bp, Homo sapiens
ggagctgtgggagacggagag

SEQ ID NO: 885 - DNA, 21 bp, Homo sapiens
gggggtgagggaaacaggaga

SEQ ID NO: 886 - DNA, 21 bp, Homo sapiens
gacggagaggggcagggtggg

SEQ ID NO: 887 - DNA, 21 bp, Homo sapiens
ggtgagggaaacaggagaatg

SEQ ID NO: 888 - DNA, 21 bp, Homo sapiens
ggagacggagaggggcagggt

SEQ ID NO: 889 - DNA, 21 bp, Homo sapiens
gggggtgggggtgagggaaac

SEQ ID NO: 890 - DNA, 21 bp, Homo sapiens
ggtgggggtgagggaaacagg

SEQ ID NO: 891 - DNA, 21 bp, Homo sapiens
ggagggggtgggggtgaggga

SEQ ID NO: 892 - DNA, 21 bp, Homo sapiens
ccgggagggggtgggggtgag

SEQ ID NO: 893 - DNA, 21 bp, Homo sapiens
cgggagggggtgggggtgagg

SEQ ID NO: 894 - DNA, 21 bp, Homo sapiens
gagggggtgggggtgagggaa

SEQ ID NO: 895 - DNA, 21 bp, Homo sapiens
ggggtgggggtgagggaaaca

SEQ ID NO: 896 - DNA, 21 bp, Homo sapiens
gtgggggtgagggaaacagga

SEQ ID NO: 897 - DNA, 21 bp, Homo sapiens
ggggtgagggaaacaggagaa

SEQ ID NO: 898 - DNA, 21 bp, Homo sapiens
gggtgagggaaacaggagaat

SEQ ID NO: 899 - DNA, 21 bp, Homo sapiens
gggtgggggtgagggaaacag

SEQ ID NO: 900 - DNA, 21 bp, Homo sapiens
tgagggaaacaggagaatgtg

SEQ ID NO: 901 - DNA, 21 bp, Homo sapiens
tgggggtgagggaaacaggag

SEQ ID NO: 902 - DNA, 21 bp, Homo sapiens
gggagggggtgggggtgaggg

SEQ ID NO: 903 - DNA, 21 bp, Homo sapiens
agggggtgggggtgagggaaa

SEQ ID NO: 904 - DNA, 21 bp, Homo sapiens
gggaaacaggagaatgtgatg

SEQ ID NO: 905 - DNA, 21 bp, Homo sapiens
aaacaggagaatgtgatggga

SEQ ID NO: 906 - DNA, 21 bp, Homo sapiens
caggagaatgtgatgggaaaa

SEQ ID NO: 907 - DNA, 21 bp, Homo sapiens
ggccagaaacactgggagctg

SEQ ID NO: 908 - DNA, 21 bp, Homo sapiens
ctgggccagaaacactgggag

SEQ ID NO: 909 - DNA, 21 bp, Homo sapiens
aaacactgggagctgtgggag

SEQ ID NO: 910 - DNA, 21 bp, Homo sapiens
gccagcctgggccagaaacac

SEQ ID NO: 911 - DNA, 21 bp, Homo sapiens
agcctgggccagaaacactgg

SEQ ID NO: 912 - DNA, 21 bp, Homo sapiens
cagaaacactgggagctgtgg

SEQ ID NO: 913 - DNA, 21 bp, Homo sapiens
gatggagccagcctgggccag

SEQ ID NO: 914 - DNA, 21 bp, Homo sapiens
ggagccagcctgggccagaaa

SEQ ID NO: 915 - DNA, 21 bp, Homo sapiens
tgggagctgtgggagacggag

SEQ ID NO: 916 - DNA, 21 bp, Homo sapiens
gagctgtgggagacggagagg

SEQ ID NO: 917 - DNA, 21 bp, Homo sapiens
ctgtgggagacggagaggggc

SEQ ID NO: 918 - DNA, 21 bp, Homo sapiens
gagacggagaggggcagggtg

SEQ ID NO: 919 - DNA, 21 bp, Homo sapiens
tgggagacggagaggggcagg

SEQ ID NO: 920 - DNA, 21 bp, Homo sapiens
cactgggagctgtgggagacg

SEQ ID NO: 921 - DNA, 21 bp, Homo sapiens
acggagaggggcagggtggga

SEQ ID NO: 922 - DNA, 21 bp, Homo sapiens
cgagatggagccagcctgggc

SEQ ID NO: 923 - DNA, 21 bp, Homo sapiens
gcctgggccagaaacactggg

SEQ ID NO: 924 - DNA, 21 bp, Homo sapiens
ccagcctgggccagaaacact

SEQ ID NO: 925 - DNA, 21 bp, Homo sapiens
tgggccagaaacactgggagc

SEQ ID NO: 926 - DNA, 21 bp, Homo sapiens
gagccagcctgggccagaaac

SEQ ID NO: 927 - DNA, 21 bp, Homo sapiens
atggagccagcctgggccaga

SEQ ID NO: 928 - DNA, 21 bp, Homo sapiens
gagatggagccagcctgggcc

SEQ ID NO: 929 - DNA, 21 bp, Homo sapiens
gggagacggagaggggcaggg

SEQ ID NO: 930 - DNA, 21 bp, Homo sapiens
agacggagaggggcagggtgg

SEQ ID NO: 931 - DNA, 21 bp, Homo sapiens
cggagaggggcagggtgggat

SEQ ID NO: 932 - DNA, 21 bp, Homo sapiens
agaggggcagggtgggatcac

SEQ ID NO: 933 - DNA, 21 bp, Homo sapiens
gatcacagggagcaggagcgg

SEQ ID NO: 934 - DNA, 21 bp, Homo sapiens
ggggcagggtgggatcacagg

SEQ ID NO: 935 - DNA, 21 bp, Homo sapiens
gggtgggatcacagggagcag

SEQ ID NO: 936 - DNA, 21 bp, Homo sapiens
tgggatcacagggagcaggag

SEQ ID NO: 937 - DNA, 21 bp, Homo sapiens
gcagggtgggatcacagggag

SEQ ID NO: 938 - DNA, 21 bp, Homo sapiens
agggagcaggagcggggaatt

SEQ ID NO: 939 - DNA, 21 bp, Homo sapiens
cacagggagcaggagcgggga

SEQ ID NO: 940 - DNA, 21 bp, Homo sapiens
gagcaggagcggggaattgga

SEQ ID NO: 941 - DNA, 21 bp, Homo sapiens
caggagcggggaattggaggt

SEQ ID NO: 942 - DNA, 21 bp, Homo sapiens
gagcggggaattggaggtgaa

SEQ ID NO: 943 - DNA, 21 bp, Homo sapiens
acagggagcaggagcggggaa

SEQ ID NO: 944 - DNA, 21 bp, Homo sapiens
gcaggagcggggaattggagg

SEQ ID NO: 945 - DNA, 21 bp, Homo sapiens
ggagcggggaattggaggtga

SEQ ID NO: 946 - DNA, 21 bp, Homo sapiens
cagggagcaggagcggggaat

SEQ ID NO: 947 - DNA, 21 bp, Homo sapiens
ggagcaggagcggggaattgg

SEQ ID NO: 948 - DNA, 21 bp, Homo sapiens
ggccctcccaaacttccagtc

SEQ ID NO: 949 - DNA, 21 bp, Homo sapiens
cctcccaaacttccagtccat

SEQ ID NO: 950 - DNA, 21 bp, Homo sapiens
gggaaactgcgggggaactgg

SEQ ID NO: 951 - DNA, 21 bp, Homo sapiens
accgggaaactgcgggggaac

SEQ ID NO: 952 - DNA, 21 bp, Homo sapiens
aaactgcgggggaactggaag

SEQ ID NO: 953 - DNA, 21 bp, Homo sapiens
ggaaccgggaaactgcggggg

SEQ ID NO: 954 - DNA, 21 bp, Homo sapiens
aggggaaccgggaaactgcgg

SEQ ID NO: 955 - DNA, 21 bp, Homo sapiens
ctgcgggggaactggaaggga

SEQ ID NO: 956 - DNA, 21 bp, Homo sapiens
cgggggaactggaagggagct

SEQ ID NO: 957 - DNA, 21 bp, Homo sapiens
cccaggggaaccgggaaactg

SEQ ID NO: 958 - DNA, 21 bp, Homo sapiens
gctcccaggggaaccgggaaa

SEQ ID NO: 959 - DNA, 21 bp, Homo sapiens
gggaactggaagggagctccc

SEQ ID NO: 960 - DNA, 21 bp, Homo sapiens
aactggaagggagctcccaga

SEQ ID NO: 961 - DNA, 21 bp, Homo sapiens
tggaagggagctcccagaaca

SEQ ID NO: 962 - DNA, 21 bp, Homo sapiens
aagggagctcccagaacaagg

SEQ ID NO: 963 - DNA, 21 bp, Homo sapiens
caggggaaccgggaaactgcg

SEQ ID NO: 964 - DNA, 21 bp, Homo sapiens
gggaaccgggaaactgcgggg

SEQ ID NO: 965 - DNA, 21 bp, Homo sapiens
aaccgggaaactgcgggggaa

SEQ ID NO: 966 - DNA, 21 bp, Homo sapiens
gcgggggaactggaagggagc

SEQ ID NO: 967 - DNA, 21 bp, Homo sapiens
actgcgggggaactggaaggg

SEQ ID NO: 968 - DNA, 21 bp, Homo sapiens
cgggaaactgcgggggaactg

SEQ ID NO: 969 - DNA, 21 bp, Homo sapiens
gaaactgcgggggaactggaa

SEQ ID NO: 970 - DNA, 21 bp, Homo sapiens
catctggggcctgggatttag

SEQ ID NO: 971 - DNA, 21 bp, Homo sapiens
gattggcatctggggcctggg

SEQ ID NO: 972 - DNA, 21 bp, Homo sapiens
tggcatctggggcctgggatt

SEQ ID NO: 973 - DNA, 21 bp, Homo sapiens
cagaacaaggatccagaagat

SEQ ID NO: 974 - DNA, 21 bp, Homo sapiens
gaagattggcatctggggcct

SEQ ID NO: 975 - DNA, 21 bp, Homo sapiens
aacaaggatccagaagattgg

SEQ ID NO: 976 - DNA, 21 bp, Homo sapiens
ccagaagattggcatctgggg

SEQ ID NO: 977 - DNA, 21 bp, Homo sapiens
gatccagaagattggcatctg

SEQ ID NO: 978 - DNA, 21 bp, Homo sapiens
aaggatccagaagattggcat

SEQ ID NO: 979 - DNA, 21 bp, Homo sapiens
ctggggcctgggatttaggtt

SEQ ID NO: 980 - DNA, 21 bp, Homo sapiens
ctaaatcgtgggccatggggc

SEQ ID NO: 981 - DNA, 21 bp, Homo sapiens
aatcgtgggccatggggcagc

SEQ ID NO: 982 - DNA, 21 bp, Homo sapiens
cgtgggccatggggcagcctt

SEQ ID NO: 983 - DNA, 21 bp, Homo sapiens
ctgcaaaagcattgagggtag

SEQ ID NO: 984 - DNA, 21 bp, Homo sapiens
caaaagcattgagggtagaag

SEQ ID NO: 985 - DNA, 21 bp, Homo sapiens
aaaagcattgagggtagaagt

SEQ ID NO: 986 - DNA, 21 bp, Homo sapiens
attgagggtagaagtcaatga

SEQ ID NO: 987 - DNA, 21 bp, Homo sapiens
agcattgagggtagaagtcaa

SEQ ID NO: 988 - DNA, 21 bp, Homo sapiens
atgatttgggaagttattgaa

SEQ ID NO: 989 - DNA, 21 bp, Homo sapiens
taggctgtcagtgcctgatag

SEQ ID NO: 990 - DNA, 21 bp, Homo sapiens
aggtaggctgtcagtgcctga

SEQ ID NO: 991 - DNA, 21 bp, Homo sapiens
cggaggtaggctgtcagtgcc

SEQ ID NO: 992 - DNA, 21 bp, Homo sapiens
tagaatgcctgacttggggtg

SEQ ID NO: 993 - DNA, 21 bp, Homo sapiens
aatgcctgacttggggtgaca

SEQ ID NO: 994 - DNA, 21 bp, Homo sapiens
agttagaatgcctgacttggg

SEQ ID NO: 995 - DNA, 21 bp, Homo sapiens
gcctgacttggggtgacaatg

SEQ ID NO: 996 - DNA, 21 bp, Homo sapiens
ggggtgacaatggcttggagg

SEQ ID NO: 997 - DNA, 21 bp, Homo sapiens
tgacttggggtgacaatggct

SEQ ID NO: 998 - DNA, 21 bp, Homo sapiens
gcttggaggggtgggtgagtc

SEQ ID NO: 999 - DNA, 21 bp, Homo sapiens
tggaggggtgggtgagtcaag

SEQ ID NO: 1000 - DNA, 21 bp, Homo sapiens
gtgacaatggcttggaggggt

SEQ ID NO: 1001 - DNA, 21 bp, Homo sapiens
atggcttggaggggtgggtga

SEQ ID NO: 1002 - DNA, 21 bp, Homo sapiens
acaatggcttggaggggtggg

SEQ ID NO: 1003 - DNA, 21 bp, Homo sapiens
gggtgagtcaagggtcaaatg

SEQ ID NO: 1004 - DNA, 21 bp, Homo sapiens
ggtcaaatgagtgcccgtgag

SEQ ID NO: 1005 - DNA, 21 bp, Homo sapiens
tgagtcaagggtcaaatgagt

SEQ ID NO: 1006 - DNA, 21 bp, Homo sapiens
gtcaagggtcaaatgagtgcc

SEQ ID NO: 1007 - DNA, 21 bp, Homo sapiens
aagggtcaaatgagtgcccgt

SEQ ID NO: 1008 - DNA, 21 bp, Homo sapiens
aggggtgggtgagtcaagggt

SEQ ID NO: 1009 - DNA, 21 bp, Homo sapiens
ggtgggtgagtcaagggtcaa

SEQ ID NO: 1010 - DNA, 21 bp, Homo sapiens
ctgacttggggtgacaatggc

SEQ ID NO: 1011 - DNA, 21 bp, Homo sapiens
gggtgacaatggcttggaggg

SEQ ID NO: 1012 - DNA, 21 bp, Homo sapiens
tgacaatggcttggaggggtg

SEQ ID NO: 1013 - DNA, 21 bp, Homo sapiens
tggcttggaggggtgggtgag

SEQ ID NO: 1014 - DNA, 21 bp, Homo sapiens
caatggcttggaggggtgggt

SEQ ID NO: 1015 - DNA, 21 bp, Homo sapiens
gaggggtgggtgagtcaaggg

SEQ ID NO: 1016 - DNA, 21 bp, Homo sapiens
agggtcaaatgagtgcccgtg

SEQ ID NO: 1017 - DNA, 21 bp, Homo sapiens
gtcaaatgagtgcccgtgagt

SEQ ID NO: 1018 - DNA, 21 bp, Homo sapiens
aaatgagtgcccgtgagtcat

SEQ ID NO: 1019 - DNA, 21 bp, Homo sapiens
tgagtgcccgtgagtcatgat

SEQ ID NO: 1020 - DNA, 21 bp, Homo sapiens
gtgcccgtgagtcatgatgcc

SEQ ID NO: 1021 - DNA, 21 bp, Homo sapiens
ccgtgagtcatgatgcctgcc

SEQ ID NO: 1022 - DNA, 21 bp, Homo sapiens
gtcagccagaaaccaacaaac

SEQ ID NO: 1023 - DNA, 21 bp, Homo sapiens
agccagaaaccaacaaacagc

SEQ ID NO: 1024 - DNA, 21 bp, Homo sapiens
cagaaaccaacaaacagccaa

SEQ ID NO: 1025 - DNA, 21 bp, Homo sapiens
gccccagcagttgtaattagc

SEQ ID NO: 1026 - DNA, 21 bp, Homo sapiens
cggtgagttagggccccagca

SEQ ID NO: 1027 - DNA, 21 bp, Homo sapiens
ggtgtcagccagaaaccaaca

SEQ ID NO: 1028 - DNA, 21 bp, Homo sapiens
agggccccagcagttgtaatt

SEQ ID NO: 1029 - DNA, 21 bp, Homo sapiens
ccagcagttgtaattagcacc

SEQ ID NO: 1030 - DNA, 21 bp, Homo sapiens
ataactgaacatcggtgagtt

SEQ ID NO: 1031 - DNA, 21 bp, Homo sapiens
catcggtgagttagggcccca

SEQ ID NO: 1032 - DNA, 21 bp, Homo sapiens
gaacatcggtgagttagggcc

SEQ ID NO: 1033 - DNA, 21 bp, Homo sapiens
accccgggtgtcagccagaaa

SEQ ID NO: 1034 - DNA, 21 bp, Homo sapiens
agcaccccgggtgtcagccag

SEQ ID NO: 1035 - DNA, 21 bp, Homo sapiens
gcagttgtaattagcaccccg

SEQ ID NO: 1036 - DNA, 21 bp, Homo sapiens
attagcaccccgggtgtcagc

SEQ ID NO: 1037 - DNA, 21 bp, Homo sapiens
gtaattagcaccccgggtgtc

SEQ ID NO: 1038 - DNA, 21 bp, Homo sapiens
tgagttagggccccagcagtt

SEQ ID NO: 1039 - DNA, 21 bp, Homo sapiens
gttagggccccagcagttgta

SEQ ID NO: 1040 - DNA, 21 bp, Homo sapiens
gttgtaattagcaccccgggt

SEQ ID NO: 1041 - DNA, 21 bp, Homo sapiens
gtgagttagggccccagcagt

SEQ ID NO: 1042 - DNA, 21 bp, Homo sapiens
cagccagaaaccaacaaacag

SEQ ID NO: 1043 - DNA, 21 bp, Homo sapiens
gaaaccaacaaacagccaaat

SEQ ID NO: 1044 - DNA, 21 bp, Homo sapiens
ccagaaaccaacaaacagcca

SEQ ID NO: 1045 - DNA, 21 bp, Homo sapiens
accaacaaacagccaaatccc

SEQ ID NO: 1046 - DNA, 21 bp, Homo sapiens
gccagaaaccaacaaacagcc

SEQ ID NO: 1047 - DNA, 21 bp, Homo sapiens
agaaaccaacaaacagccaaa

SEQ ID NO: 1048 - DNA, 21 bp, Homo sapiens
accggcgggggaccgattaac

SEQ ID NO: 1049 - DNA, 21 bp, Homo sapiens
acccccacccctccccggcag

SEQ ID NO: 1050 - DNA, 21 bp, Homo sapiens
cacagaggctaggccaagact

SEQ ID NO: 1051 - DNA, 21 bp, Homo sapiens
cttcacagaggctaggccaag

SEQ ID NO: 1052 - DNA, 21 bp, Homo sapiens
taggccaagactcccagcaga

SEQ ID NO: 1053 - DNA, 21 bp, Homo sapiens
ggctaggccaagactcccagc

SEQ ID NO: 1054 - DNA, 21 bp, Homo sapiens
ccccttcacagaggctaggcc

SEQ ID NO: 1055 - DNA, 21 bp, Homo sapiens
ccaccccttcacagaggctag

SEQ ID NO: 1056 - DNA, 21 bp, Homo sapiens
cctccaccccttcacagaggc

SEQ ID NO: 1057 - DNA, 21 bp, Homo sapiens
gcagagcctccaccccttcac

SEQ ID NO: 1058 - DNA, 21 bp, Homo sapiens
gagcctccaccccttcacaga

SEQ ID NO: 1059 - DNA, 21 bp, Homo sapiens
ccggcagagcctccacccctt

SEQ ID NO: 1060 - DNA, 21 bp, Homo sapiens
gcagatcttcccagaggacgg

SEQ ID NO: 1061 - DNA, 21 bp, Homo sapiens
ggcagagagggcactgggagg

SEQ ID NO: 1062 - DNA, 21 bp, Homo sapiens
gaaggcagagagggcactggg

SEQ ID NO: 1063 - DNA, 21 bp, Homo sapiens
gagggcactgggaggaggcag

SEQ ID NO: 1064 - DNA, 21 bp, Homo sapiens
agagagggcactgggaggagg

SEQ ID NO: 1065 - DNA, 21 bp, Homo sapiens
gggaggaggcagtgggagggc

SEQ ID NO: 1066 - DNA, 21 bp, Homo sapiens
ggcactgggaggaggcagtgg

SEQ ID NO: 1067 - DNA, 21 bp, Homo sapiens
gagggcggagggcgggggcct

SEQ ID NO: 1068 - DNA, 21 bp, Homo sapiens
actgggaggaggcagtgggag

SEQ ID NO: 1069 - DNA, 21 bp, Homo sapiens
tgaaaggaaggcagagagggc

SEQ ID NO: 1070 - DNA, 21 bp, Homo sapiens
aaggaaggcagagagggcact

SEQ ID NO: 1071 - DNA, 21 bp, Homo sapiens
tgggagggcggagggcggggg

SEQ ID NO: 1072 - DNA, 21 bp, Homo sapiens
cagtgggagggcggagggcgg

SEQ ID NO: 1073 - DNA, 21 bp, Homo sapiens
aggcagtgggagggcggaggg

SEQ ID NO: 1074 - DNA, 21 bp, Homo sapiens
aggaggcagtgggagggcgga

SEQ ID NO: 1075 - DNA, 21 bp, Homo sapiens
acggtttgaaaggaaggcaga

SEQ ID NO: 1076 - DNA, 21 bp, Homo sapiens
aggacggtttgaaaggaaggc

SEQ ID NO: 1077 - DNA, 21 bp, Homo sapiens
cagaggacggtttgaaaggaa

SEQ ID NO: 1078 - DNA, 21 bp, Homo sapiens
gggcgcccagggtagggcagg

SEQ ID NO: 1079 - DNA, 21 bp, Homo sapiens
cgcccagggtagggcaggtgg

SEQ ID NO: 1080 - DNA, 21 bp, Homo sapiens
gggagggcggagggcgggggc

SEQ ID NO: 1081 - DNA, 21 bp, Homo sapiens
cggcgtggaggcagggagaat

SEQ ID NO: 1082 - DNA, 21 bp, Homo sapiens
aggaaggcagagagggcactg

SEQ ID NO: 1083 - DNA, 21 bp, Homo sapiens
tagggcaggtggccgcggcgt

SEQ ID NO: 1084 - DNA, 21 bp, Homo sapiens
gggtagggcaggtggccgcgg

SEQ ID NO: 1085 - DNA, 21 bp, Homo sapiens
ccagggtagggcaggtggccg

SEQ ID NO: 1086 - DNA, 21 bp, Homo sapiens
gcggagggcgggggccttcgg

SEQ ID NO: 1087 - DNA, 21 bp, Homo sapiens
gaaaggaaggcagagagggca

SEQ ID NO: 1088 - DNA, 21 bp, Homo sapiens
ggcagtgggagggcggagggc

SEQ ID NO: 1089 - DNA, 21 bp, Homo sapiens
agtgggagggcggagggcggg

SEQ ID NO: 1090 - DNA, 21 bp, Homo sapiens
agggcggagggcgggggcctt

SEQ ID NO: 1091 - DNA, 21 bp, Homo sapiens
aaggcagagagggcactggga

SEQ ID NO: 1092 - DNA, 21 bp, Homo sapiens
cgtggaggcagggagaatgcg

SEQ ID NO: 1093 - DNA, 21 bp, Homo sapiens
gcagagagggcactgggagga

SEQ ID NO: 1094 - DNA, 21 bp, Homo sapiens
gagagggcactgggaggaggc

SEQ ID NO: 1095 - DNA, 21 bp, Homo sapiens
aggtggccgcggcgtggaggc

SEQ ID NO: 1096 - DNA, 21 bp, Homo sapiens
tggccgcggcgtggaggcagg

SEQ ID NO: 1097 - DNA, 21 bp, Homo sapiens
ggcaggtggccgcggcgtgga

SEQ ID NO: 1098 - DNA, 21 bp, Homo sapiens
ggaggcagggagaatgcgact

SEQ ID NO: 1099 - DNA, 21 bp, Homo sapiens
gcactgggaggaggcagtggg

SEQ ID NO: 1100 - DNA, 21 bp, Homo sapiens
ggaggcagtgggagggcggag

SEQ ID NO: 1101 - DNA, 21 bp, Homo sapiens
agggcactgggaggaggcagt

SEQ ID NO: 1102 - DNA, 21 bp, Homo sapiens
ctgggaggaggcagtgggagg

SEQ ID NO: 1103 - DNA, 21 bp, Homo sapiens
ggtgggcgcccagggtagggc

SEQ ID NO: 1104 - DNA, 21 bp, Homo sapiens
cggggtgggcgcccagggtag

SEQ ID NO: 1105 - DNA, 21 bp, Homo sapiens
ggcgggggccttcggggtggg

SEQ ID NO: 1106 - DNA, 21 bp, Homo sapiens
gagggcgggggccttcggggt

SEQ ID NO: 1107 - DNA, 21 bp, Homo sapiens
gggggccttcggggtgggcgc

SEQ ID NO: 1108 - DNA, 21 bp, Homo sapiens
ggaggaggcagtgggagggcg

SEQ ID NO: 1109 - DNA, 21 bp, Homo sapiens
ggccttcggggtgggcgccca

SEQ ID NO: 1110 - DNA, 21 bp, Homo sapiens
cttcggggtgggcgcccaggg

SEQ ID NO: 1111 - DNA, 21 bp, Homo sapiens
cagagagggcactgggaggag

SEQ ID NO: 1112 - DNA, 21 bp, Homo sapiens
agagggcactgggaggaggca

SEQ ID NO: 1113 - DNA, 21 bp, Homo sapiens
gggcactgggaggaggcagtg

SEQ ID NO: 1114 - DNA, 21 bp, Homo sapiens
aggcagagagggcactgggag

SEQ ID NO: 1115 - DNA, 21 bp, Homo sapiens
gaggaggcagtgggagggcgg

SEQ ID NO: 1116 - DNA, 21 bp, Homo sapiens
tgggaggaggcagtgggaggg

SEQ ID NO: 1117 - DNA, 21 bp, Homo sapiens
gaggcagtgggagggcggagg

SEQ ID NO: 1118 - DNA, 21 bp, Homo sapiens
cactgggaggaggcagtggga

SEQ ID NO: 1119 - DNA, 21 bp, Homo sapiens
aaaggaaggcagagagggcac

SEQ ID NO: 1120 - DNA, 21 bp, Homo sapiens
ggaaggcagagagggcactgg

SEQ ID NO: 1121 - DNA, 21 bp, Homo sapiens
gtgggagggcggagggcgggg

SEQ ID NO: 1122 - DNA, 21 bp, Homo sapiens
gcagtgggagggcggagggcg

SEQ ID NO: 1123 - DNA, 21 bp, Homo sapiens
ggagggcggagggcgggggcc

SEQ ID NO: 1124 - DNA, 21 bp, Homo sapiens
cgcggcgtggaggcagggaga

SEQ ID NO: 1125 - DNA, 21 bp, Homo sapiens
ggccgcggcgtggaggcaggg

SEQ ID NO: 1126 - DNA, 21 bp, Homo sapiens
ggcgtggaggcagggagaatg

SEQ ID NO: 1127 - DNA, 21 bp, Homo sapiens
gtggaggcagggagaatgcga

SEQ ID NO: 1128 - DNA, 21 bp, Homo sapiens
ggggtgggcgcccagggtagg

SEQ ID NO: 1129 - DNA, 21 bp, Homo sapiens
gtgggcgcccagggtagggca

SEQ ID NO: 1130 - DNA, 21 bp, Homo sapiens
gcaggtggccgcggcgtggag

SEQ ID NO: 1131 - DNA, 21 bp, Homo sapiens
ggtggccgcggcgtggaggca

SEQ ID NO: 1132 - DNA, 21 bp, Homo sapiens
agggcaggtggccgcggcgtg

SEQ ID NO: 1133 - DNA, 21 bp, Homo sapiens
gcccagggtagggcaggtggc

SEQ ID NO: 1134 - DNA, 21 bp, Homo sapiens
ggcgcccagggtagggcaggt

SEQ ID NO: 1135 - DNA, 21 bp, Homo sapiens
cagggtagggcaggtggccgc

SEQ ID NO: 1136 - DNA, 21 bp, Homo sapiens
ggtagggcaggtggccgcggc

SEQ ID NO: 1137 - DNA, 21 bp, Homo sapiens
agggtagggcaggtggccgcg

SEQ ID NO: 1138 - DNA, 21 bp, Homo sapiens
cccagggtagggcaggtggcc

SEQ ID NO: 1139 - DNA, 21 bp, Homo sapiens
gtagggcaggtggccgcggcg

SEQ ID NO: 1140 - DNA, 21 bp, Homo sapiens
gggcaggtggccgcggcgtgg

SEQ ID NO: 1141 - DNA, 21 bp, Homo sapiens
gtggccgcggcgtggaggcag

SEQ ID NO: 1142 - DNA, 21 bp, Homo sapiens
caggtggccgcggcgtggagg

SEQ ID NO: 1143 - DNA, 21 bp, Homo sapiens
gcgcccagggtagggcaggtg

SEQ ID NO: 1144 - DNA, 21 bp, Homo sapiens
gggtgggcgcccagggtaggg

SEQ ID NO: 1145 - DNA, 21 bp, Homo sapiens
tgggcgcccagggtagggcag

SEQ ID NO: 1146 - DNA, 21 bp, Homo sapiens
gcggcgtggaggcagggagaa

SEQ ID NO: 1147 - DNA, 21 bp, Homo sapiens
gccgcggcgtggaggcaggga

SEQ ID NO: 1148 - DNA, 21 bp, Homo sapiens
aaccctcgtcgacatggacat

SEQ ID NO: 1149 - DNA, 21 bp, Homo sapiens
cctcgtcgacatggacatggc

SEQ ID NO: 1150 - DNA, 21 bp, Homo sapiens
catggacatggccgactacag

SEQ ID NO: 1151 - DNA, 21 bp, Homo sapiens
caaaaccctcgtcgacatgga

SEQ ID NO: 1152 - DNA, 21 bp, Homo sapiens
cgtcgacatggacatggccga

SEQ ID NO: 1153 - DNA, 21 bp, Homo sapiens
cgacatggacatggccgacta

SEQ ID NO: 1154 - DNA, 21 bp, Homo sapiens
gtcgacatggacatggccgac

SEQ ID NO: 1155 - DNA, 21 bp, Homo sapiens
gtgctgcactggacccagcct

SEQ ID NO: 1156 - DNA, 21 bp, Homo sapiens
acagtgctgcactggacccag

SEQ ID NO: 1157 - DNA, 21 bp, Homo sapiens
ctgcactggacccagcctaca

SEQ ID NO: 1158 - DNA, 21 bp, Homo sapiens
cactggacccagcctacacca

SEQ ID NO: 1159 - DNA, 21 bp, Homo sapiens
actacagtgctgcactggacc

SEQ ID NO: 1160 - DNA, 21 bp, Homo sapiens
acatggccgactacagtgctg

SEQ ID NO: 1161 - DNA, 21 bp, Homo sapiens
tggacatggccgactacagtg

SEQ ID NO: 1162 - DNA, 21 bp, Homo sapiens
cagcctacaccaccctggaat

SEQ ID NO: 1163 - DNA, 21 bp, Homo sapiens
acatggacatggccgactaca

SEQ ID NO: 1164 - DNA, 21 bp, Homo sapiens
tggacccagcctacaccaccc

SEQ ID NO: 1165 - DNA, 21 bp, Homo sapiens
acccagcctacaccaccctgg

SEQ ID NO: 1166 - DNA, 21 bp, Homo sapiens
ccgactacagtgctgcactgg

SEQ ID NO: 1167 - DNA, 21 bp, Homo sapiens
tggccgactacagtgctgcac

SEQ ID NO: 1168 - DNA, 21 bp, Homo sapiens
agtgctgcactggacccagcc

SEQ ID NO: 1169 - DNA, 21 bp, Homo sapiens
ctacaccaccctggaatttga

SEQ ID NO: 1170 - DNA, 21 bp, Homo sapiens
agcctacaccaccctggaatt

SEQ ID NO: 1171 - DNA, 21 bp, Homo sapiens
caccaccctggaatttgagaa

SEQ ID NO: 1172 - DNA, 21 bp, Homo sapiens
ggacccagcctacaccaccct

SEQ ID NO: 1173 - DNA, 21 bp, Homo sapiens
cccagcctacaccaccctgga

SEQ ID NO: 1174 - DNA, 21 bp, Homo sapiens
actggacccagcctacaccac

SEQ ID NO: 1175 - DNA, 21 bp, Homo sapiens
tggtaggtgggggcagatgtg

SEQ ID NO: 1176 - DNA, 21 bp, Homo sapiens
taggtgggggcagatgtgccc

SEQ ID NO: 1177 - DNA, 21 bp, Homo sapiens
gatgggcaatggtaggtgggg

SEQ ID NO: 1178 - DNA, 21 bp, Homo sapiens
gggcaatggtaggtgggggca

SEQ ID NO: 1179 - DNA, 21 bp, Homo sapiens
caatggtaggtgggggcagat

SEQ ID NO: 1180 - DNA, 21 bp, Homo sapiens
gtgggggcagatgtgcccagg

SEQ ID NO: 1181 - DNA, 21 bp, Homo sapiens
gacgatgggcaatggtaggtg

SEQ ID NO: 1182 - DNA, 21 bp, Homo sapiens
gttgacgatgggcaatggtag

SEQ ID NO: 1183 - DNA, 21 bp, Homo sapiens
gcaggtgttgacgatgggcaa

SEQ ID NO: 1184 - DNA, 21 bp, Homo sapiens
ggtgttgacgatgggcaatgg

SEQ ID NO: 1185 - DNA, 21 bp, Homo sapiens
gcaatggtaggtgggggcaga

SEQ ID NO: 1186 - DNA, 21 bp, Homo sapiens
tgggcaatggtaggtgggggc

SEQ ID NO: 1187 - DNA, 21 bp, Homo sapiens
tgacgatgggcaatggtaggt

SEQ ID NO: 1188 - DNA, 21 bp, Homo sapiens
cgatgggcaatggtaggtggg

SEQ ID NO: 1189 - DNA, 21 bp, Homo sapiens
ggcaatggtaggtgggggcag

SEQ ID NO: 1190 - DNA, 21 bp, Homo sapiens
atgggcaatggtaggtggggg

SEQ ID NO: 1191 - DNA, 21 bp, Homo sapiens
aatggtaggtgggggcagatg

SEQ ID NO: 1192 - DNA, 21 bp, Homo sapiens
acgatgggcaatggtaggtgg

SEQ ID NO: 1193 - DNA, 21 bp, Homo sapiens
gtgggggcaggtgtgcctggg

SEQ ID NO: 1194 - DNA, 21 bp, Homo sapiens
ccagtgggggcaggtgtgcct

SEQ ID NO: 1195 - DNA, 21 bp, Homo sapiens
gtgccagtgggggcaggtgtg

SEQ ID NO: 1196 - DNA, 21 bp, Homo sapiens
ccaggtgtgccagtgggggca

SEQ ID NO: 1197 - DNA, 21 bp, Homo sapiens
ggtgtgccagtgggggcaggt

SEQ ID NO: 1198 - DNA, 21 bp, Homo sapiens
ccaggagcagatctttggcac

SEQ ID NO: 1199 - DNA, 21 bp, Homo sapiens
ctgggtccaggagcagatctt

SEQ ID NO: 1200 - DNA, 21 bp, Homo sapiens
ggtccaggagcagatctttgg

SEQ ID NO: 1201 - DNA, 21 bp, Homo sapiens
gggaggagaatgatacaaaat

SEQ ID NO: 1202 - DNA, 21 bp, Homo sapiens
tggggtgggaggagaatgata

SEQ ID NO: 1203 - DNA, 21 bp, Homo sapiens
ctttggggtgggaggagaatg

SEQ ID NO: 1204 - DNA, 21 bp, Homo sapiens
ggcactcaactttggggtggg

SEQ ID NO: 1205 - DNA, 21 bp, Homo sapiens
aggagaatgatacaaaatggt

SEQ ID NO: 1206 - DNA, 21 bp, Homo sapiens
agaatgatacaaaatggtagg

SEQ ID NO: 1207 - DNA, 21 bp, Homo sapiens
ggtgggaggagaatgatacaa

SEQ ID NO: 1208 - DNA, 21 bp, Homo sapiens
caactttggggtgggaggaga

SEQ ID NO: 1209 - DNA, 21 bp, Homo sapiens
actcaactttggggtgggagg

SEQ ID NO: 1210 - DNA, 21 bp, Homo sapiens
gggtgggaggagaatgataca

SEQ ID NO: 1211 - DNA, 21 bp, Homo sapiens
gagaatgatacaaaatggtag

SEQ ID NO: 1212 - DNA, 21 bp, Homo sapiens
tgggaggagaatgatacaaaa

SEQ ID NO: 1213 - DNA, 21 bp, Homo sapiens
gaggagaatgatacaaaatgg

SEQ ID NO: 1214 - DNA, 21 bp, Homo sapiens
aatgatacaaaatggtaggtt

SEQ ID NO: 1215 - DNA, 21 bp, Homo sapiens
ggtcctacaggccagcacagg

SEQ ID NO: 1216 - DNA, 21 bp, Homo sapiens
taggttggtcctacaggccag

SEQ ID NO: 1217 - DNA, 21 bp, Homo sapiens
tggtaggttggtcctacaggc

SEQ ID NO: 1218 - DNA, 21 bp, Homo sapiens
aaatggtaggttggtcctaca

SEQ ID NO: 1219 - DNA, 21 bp, Homo sapiens
acaaaatggtaggttggtcct

SEQ ID NO: 1220 - DNA, 21 bp, Homo sapiens
gatacaaaatggtaggttggt

SEQ ID NO: 1221 - DNA, 21 bp, Homo sapiens
gttggtcctacaggccagcac

SEQ ID NO: 1222 - DNA, 21 bp, Homo sapiens
gtcctacaggccagcacaggt

SEQ ID NO: 1223 - DNA, 21 bp, Homo sapiens
caggccagcacaggtgttgcc

SEQ ID NO: 1224 - DNA, 21 bp, Homo sapiens
ctacaggccagcacaggtgtt

SEQ ID NO: 1225 - DNA, 21 bp, Homo sapiens
ggtgttgccaagtgaagccca

SEQ ID NO: 1226 - DNA, 21 bp, Homo sapiens
agcacaggtgttgccaagtga

SEQ ID NO: 1227 - DNA, 21 bp, Homo sapiens
acaggtgttgccaagtgaagc

SEQ ID NO: 1228 - DNA, 21 bp, Homo sapiens
gccagcacaggtgttgccaag

SEQ ID NO: 1229 - DNA, 21 bp, Homo sapiens
aggcacagtgatcacaggcat

SEQ ID NO: 1230 - DNA, 21 bp, Homo sapiens
ccaagtgaagcccatgtgccc

SEQ ID NO: 1231 - DNA, 21 bp, Homo sapiens
gaagcccatgtgcccaggcac

SEQ ID NO: 1232 - DNA, 21 bp, Homo sapiens
agtgaagcccatgtgcccagg

SEQ ID NO: 1233 - DNA, 21 bp, Homo sapiens
gtgcccaggcacagtgatcac

SEQ ID NO: 1234 - DNA, 21 bp, Homo sapiens
gcccatgtgcccaggcacagt

SEQ ID NO: 1235 - DNA, 21 bp, Homo sapiens
catgtgcccaggcacagtgat

SEQ ID NO: 1236 - DNA, 21 bp, Homo sapiens
cccaggcacagtgatcacagg

SEQ ID NO: 1237 - DNA, 21 bp, Homo sapiens
gggaggcctgcaagggccaat

SEQ ID NO: 1238 - DNA, 21 bp, Homo sapiens
gaagggaggcctgcaagggcc

SEQ ID NO: 1239 - DNA, 21 bp, Homo sapiens
acaggcattctgggtgaaggg

SEQ ID NO: 1240 - DNA, 21 bp, Homo sapiens
ctgggtgaagggaggcctgca

SEQ ID NO: 1241 - DNA, 21 bp, Homo sapiens
attctgggtgaagggaggcct

SEQ ID NO: 1242 - DNA, 21 bp, Homo sapiens
ggcattctgggtgaagggagg

SEQ ID NO: 1243 - DNA, 21 bp, Homo sapiens
ggtgaagggaggcctgcaagg

SEQ ID NO: 1244 - DNA, 21 bp, Homo sapiens
ggaggcctgcaagggccaatt

SEQ ID NO: 1245 - DNA, 21 bp, Homo sapiens
gtgaagggaggcctgcaaggg

SEQ ID NO: 1246 - DNA, 21 bp, Homo sapiens
tgggtgaagggaggcctgcaa

SEQ ID NO: 1247 - DNA, 21 bp, Homo sapiens
aagggaggcctgcaagggcca

SEQ ID NO: 1248 - DNA, 21 bp, Homo sapiens
actgtgcctgggcacatgggc

SEQ ID NO: 1249 - DNA, 21 bp, Homo sapiens
gcctgggcacatgggcttcac

SEQ ID NO: 1250 - DNA, 21 bp, Homo sapiens
gctggcctgtaggaccaacct

SEQ ID NO: 1251 - DNA, 21 bp, Homo sapiens
ggcctgtaggaccaacctacc

SEQ ID NO: 1252 - DNA, 21 bp, Homo sapiens
ctgtaggaccaacctaccatt

SEQ ID NO: 1253 - DNA, 21 bp, Homo sapiens
ccaccccaaagttgagtgcca

SEQ ID NO: 1254 - DNA, 21 bp, Homo sapiens
ccccaaagttgagtgccaaag

SEQ ID NO: 1255 - DNA, 21 bp, Homo sapiens
gctcctggacccaggcacacc

SEQ ID NO: 1256 - DNA, 21 bp, Homo sapiens
ctggacccaggcacacctgcc

SEQ ID NO: 1257 - DNA, 21 bp, Homo sapiens
gcccccactggcacacctggg

SEQ ID NO: 1258 - DNA, 21 bp, Homo sapiens
cctgcccccactggcacacct

SEQ ID NO: 1259 - DNA, 21 bp, Homo sapiens
ggcacacctgcccccactggc

SEQ ID NO: 1260 - DNA, 21 bp, Homo sapiens
acacctgcccccactggcaca

SEQ ID NO: 1261 - DNA, 21 bp, Homo sapiens
ccaggcacacctgcccccact

SEQ ID NO: 1262 - DNA, 21 bp, Homo sapiens
cccactggcacacctgggcac

SEQ ID NO: 1263 - DNA, 21 bp, Homo sapiens
gacccaggcacacctgccccc

SEQ ID NO: 1264 - DNA, 21 bp, Homo sapiens
ccactggcacacctgggcaca

SEQ ID NO: 1265 - DNA, 21 bp, Homo sapiens
gcacacctgcccccactggca

SEQ ID NO: 1266 - DNA, 21 bp, Homo sapiens
ctgcccccactggcacacctg

SEQ ID NO: 1267 - DNA, 21 bp, Homo sapiens
cccccactggcacacctgggc

SEQ ID NO: 1268 - DNA, 21 bp, Homo sapiens
caggcacacctgcccccactg

SEQ ID NO: 1269 - DNA, 21 bp, Homo sapiens
tggacccaggcacacctgccc

SEQ ID NO: 1270 - DNA, 21 bp, Homo sapiens
acccaggcacacctgccccca

SEQ ID NO: 1271 - DNA, 21 bp, Homo sapiens
cacctgcccccactggcacac

SEQ ID NO: 1272 - DNA, 21 bp, Homo sapiens
ccacctaccattgcccatcgt

SEQ ID NO: 1273 - DNA, 21 bp, Homo sapiens
tggcacacctgggcacatctg

SEQ ID NO: 1274 - DNA, 21 bp, Homo sapiens
cactggcacacctgggcacat

SEQ ID NO: 1275 - DNA, 21 bp, Homo sapiens
ctgcccccacctaccattgcc

SEQ ID NO: 1276 - DNA, 21 bp, Homo sapiens
tgggcacatctgcccccacct

SEQ ID NO: 1277 - DNA, 21 bp, Homo sapiens
acctgggcacatctgccccca

SEQ ID NO: 1278 - DNA, 21 bp, Homo sapiens
gcacatctgcccccacctacc

SEQ ID NO: 1279 - DNA, 21 bp, Homo sapiens
cctaccattgcccatcgtcaa

SEQ ID NO: 1280 - DNA, 21 bp, Homo sapiens
catctgcccccacctaccatt

SEQ ID NO: 1281 - DNA, 21 bp, Homo sapiens
ccccactggcacacctgggca

SEQ ID NO: 1282 - DNA, 21 bp, Homo sapiens
cccccacctaccattgcccat

SEQ ID NO: 1283 - DNA, 21 bp, Homo sapiens
cacacctgggcacatctgccc

SEQ ID NO: 1284 - DNA, 21 bp, Homo sapiens
attgcccatcgtcaacacctg

SEQ ID NO: 1285 - DNA, 21 bp, Homo sapiens
catcgtcaacacctgcacatt

SEQ ID NO: 1286 - DNA, 21 bp, Homo sapiens
accattgcccatcgtcaacac

SEQ ID NO: 1287 - DNA, 21 bp, Homo sapiens
gcccatcgtcaacacctgcac

SEQ ID NO: 1288 - DNA, 21 bp, Homo sapiens
cagggtggtgtaggctgggtc

SEQ ID NO: 1289 - DNA, 21 bp, Homo sapiens
ggtggtgtaggctgggtccag

SEQ ID NO: 1290 - DNA, 21 bp, Homo sapiens
aggctgggtccagtgcagcac

SEQ ID NO: 1291 - DNA, 21 bp, Homo sapiens
agcactgtagtcggccatgtc

SEQ ID NO: 1292 - DNA, 21 bp, Homo sapiens
actgtagtcggccatgtccat

SEQ ID NO: 1293 - DNA, 21 bp, Homo sapiens
gtagtcggccatgtccatgtc

SEQ ID NO: 1294 - DNA, 21 bp, Homo sapiens
gtcggccatgtccatgtcgac

SEQ ID NO: 1295 - DNA, 21 bp, Homo sapiens
ggccatgtccatgtcgacgag

SEQ ID NO: 1296 - DNA, 21 bp, Homo sapiens
catgtccatgtcgacgagggt

SEQ ID NO: 1297 - DNA, 21 bp, Homo sapiens
ctgcctccacgccgcggccac

SEQ ID NO: 1298 - DNA, 21 bp, Homo sapiens
cctccacgccgcggccacctg

SEQ ID NO: 1299 - DNA, 21 bp, Homo sapiens
ccacgccgcggccacctgccc

SEQ ID NO: 1300 - DNA, 21 bp, Homo sapiens
cggccacctgccctaccctgg

SEQ ID NO: 1301 - DNA, 21 bp, Homo sapiens
acgccgcggccacctgcccta

SEQ ID NO: 1302 - DNA, 21 bp, Homo sapiens
ccgcggccacctgccctaccc

SEQ ID NO: 1303 - DNA, 21 bp, Homo sapiens
ccacctgccctaccctgggcg

SEQ ID NO: 1304 - DNA, 21 bp, Homo sapiens
cctgccctaccctgggcgccc

SEQ ID NO: 1305 - DNA, 21 bp, Homo sapiens
gccctaccctgggcgcccacc

SEQ ID NO: 1306 - DNA, 21 bp, Homo sapiens
ccctgggcgcccaccccgaag

SEQ ID NO: 1307 - DNA, 21 bp, Homo sapiens
tgggcgcccaccccgaaggcc

SEQ ID NO: 1308 - DNA, 21 bp, Homo sapiens
ctaccctgggcgcccaccccg

SEQ ID NO: 1309 - DNA, 21 bp, Homo sapiens
cccaccccgaaggcccccgcc

SEQ ID NO: 1310 - DNA, 21 bp, Homo sapiens
gcgcccaccccgaaggccccc

SEQ ID NO: 1311 - DNA, 21 bp, Homo sapiens
cctaccctgggcgcccacccc

SEQ ID NO: 1312 - DNA, 21 bp, Homo sapiens
ctgggcgcccaccccgaaggc

SEQ ID NO: 1313 - DNA, 21 bp, Homo sapiens
ggcgcccaccccgaaggcccc

SEQ ID NO: 1314 - DNA, 21 bp, Homo sapiens
caccccgaaggcccccgccct

SEQ ID NO: 1315 - DNA, 21 bp, Homo sapiens
gcccaccccgaaggcccccgc

SEQ ID NO: 1316 - DNA, 21 bp, Homo sapiens
cccgaaggcccccgccctccg

SEQ ID NO: 1317 - DNA, 21 bp, Homo sapiens
gaaggcccccgccctccgccc

SEQ ID NO: 1318 - DNA, 21 bp, Homo sapiens
cctgggcgcccaccccgaagg

SEQ ID NO: 1319 - DNA, 21 bp, Homo sapiens
gggcgcccaccccgaaggccc

SEQ ID NO: 1320 - DNA, 21 bp, Homo sapiens
cgcccaccccgaaggcccccg

SEQ ID NO: 1321 - DNA, 21 bp, Homo sapiens
ccaccccgaaggcccccgccc

SEQ ID NO: 1322 - DNA, 21 bp, Homo sapiens
ccactgcctcctcccagtgcc

SEQ ID NO: 1323 - DNA, 21 bp, Homo sapiens
tgggaagatctgctgggagtc

SEQ ID NO: 1324 - DNA, 21 bp, Homo sapiens
gctgggagtcttggcctagcc

SEQ ID NO: 1325 - DNA, 21 bp, Homo sapiens
gcctagcctctgtgaaggggt

SEQ ID NO: 1326 - DNA, 21 bp, Homo sapiens
tagcctctgtgaaggggtgga

SEQ ID NO: 1327 - DNA, 21 bp, Homo sapiens
cctctgtgaaggggtggaggc

SEQ ID NO: 1328 - DNA, 21 bp, Homo sapiens
ggggtggaggctctgccgggg

SEQ ID NO: 1329 - DNA, 21 bp, Homo sapiens
gtggaggctctgccggggagg

SEQ ID NO: 1330 - DNA, 21 bp, Homo sapiens
gaggctctgccggggaggggt

SEQ ID NO: 1331 - DNA, 21 bp, Homo sapiens
gctctgccggggaggggtggg

SEQ ID NO: 1332 - DNA, 21 bp, Homo sapiens
ctgccggggaggggtgggggt

SEQ ID NO: 1333 - DNA, 21 bp, Homo sapiens
cggggaggggtgggggttaat

SEQ ID NO: 1334 - DNA, 21 bp, Homo sapiens
ggcggggctgcagggatttgg

SEQ ID NO: 1335 - DNA, 21 bp, Homo sapiens
ctgggcggggctgcagggatt

SEQ ID NO: 1336 - DNA, 21 bp, Homo sapiens
ggggctgcagggatttggctg

SEQ ID NO: 1337 - DNA, 21 bp, Homo sapiens
gtggataggctgggcggggct

SEQ ID NO: 1338 - DNA, 21 bp, Homo sapiens
gataggctgggcggggctgca

SEQ ID NO: 1339 - DNA, 21 bp, Homo sapiens
ccggtggataggctgggcggg

SEQ ID NO: 1340 - DNA, 21 bp, Homo sapiens
ccgccggtggataggctgggc

SEQ ID NO: 1341 - DNA, 21 bp, Homo sapiens
cccccgccggtggataggctg

SEQ ID NO: 1342 - DNA, 21 bp, Homo sapiens
ggtcccccgccggtggatagg

SEQ ID NO: 1343 - DNA, 21 bp, Homo sapiens
ataggctgggcggggctgcag

SEQ ID NO: 1344 - DNA, 21 bp, Homo sapiens
cggtggataggctgggcgggg

SEQ ID NO: 1345 - DNA, 21 bp, Homo sapiens
tggataggctgggcggggctg

SEQ ID NO: 1346 - DNA, 21 bp, Homo sapiens
cgccggtggataggctgggcg

SEQ ID NO: 1347 - DNA, 21 bp, Homo sapiens
gtcccccgccggtggataggc

SEQ ID NO: 1348 - DNA, 21 bp, Homo sapiens
ccccgccggtggataggctgg

SEQ ID NO: 1349 - DNA, 21 bp, Homo sapiens
ggctgggcggggctgcaggga

SEQ ID NO: 1350 - DNA, 21 bp, Homo sapiens
ggtggataggctgggcggggc

SEQ ID NO: 1351 - DNA, 21 bp, Homo sapiens
gccggtggataggctgggcgg

SEQ ID NO: 1352 - DNA, 21 bp, Homo sapiens
cccgccggtggataggctggg

SEQ ID NO: 1353 - DNA, 21 bp, Homo sapiens
gctgacacccggggtgctaat

SEQ ID NO: 1354 - DNA, 21 bp, Homo sapiens
ctggctgacacccggggtgct

SEQ ID NO: 1355 - DNA, 21 bp, Homo sapiens
acaactgctggggccctaact

SEQ ID NO: 1356 - DNA, 21 bp, Homo sapiens
ctaattacaactgctggggcc

SEQ ID NO: 1357 - DNA, 21 bp, Homo sapiens
attacaactgctggggcccta

SEQ ID NO: 1358 - DNA, 21 bp, Homo sapiens
gtgctaattacaactgctggg

SEQ ID NO: 1359 - DNA, 21 bp, Homo sapiens
ggggtgctaattacaactgct

SEQ ID NO: 1360 - DNA, 21 bp, Homo sapiens
actgctggggccctaactcac

SEQ ID NO: 1361 - DNA, 21 bp, Homo sapiens
cccggggtgctaattacaact

SEQ ID NO: 1362 - DNA, 21 bp, Homo sapiens
tggctgacacccggggtgcta

SEQ ID NO: 1363 - DNA, 21 bp, Homo sapiens
acacccggggtgctaattaca

SEQ ID NO: 1364 - DNA, 21 bp, Homo sapiens
ctgacacccggggtgctaatt

SEQ ID NO: 1365 - DNA, 21 bp, Homo sapiens
gctggggccctaactcaccga

SEQ ID NO: 1366 - DNA, 21 bp, Homo sapiens
attgtacaaggcaggcatcat

SEQ ID NO: 1367 - DNA, 21 bp, Homo sapiens
gtacaaggcaggcatcatgac

SEQ ID NO: 1368 - DNA, 21 bp, Homo sapiens
attgtcaccccaagtcaggca

SEQ ID NO: 1369 - DNA, 21 bp, Homo sapiens
gccattgtcaccccaagtcag

SEQ ID NO: 1370 - DNA, 21 bp, Homo sapiens
caagccattgtcaccccaagt

SEQ ID NO: 1371 - DNA, 21 bp, Homo sapiens
ggcactgacagcctacctccg

SEQ ID NO: 1372 - DNA, 21 bp, Homo sapiens
actgacagcctacctccgaga

SEQ ID NO: 1373 - DNA, 21 bp, Homo sapiens
ccaaatcattgacttctaccc

SEQ ID NO: 1374 - DNA, 21 bp, Homo sapiens
gcagagataaggctgccccat

SEQ ID NO: 1375 - DNA, 21 bp, Homo sapiens
gagataaggctgccccatggc

SEQ ID NO: 1376 - DNA, 21 bp, Homo sapiens
ataaggctgccccatggccca

SEQ ID NO: 1377 - DNA, 21 bp, Homo sapiens
aggctgccccatggcccacga

SEQ ID NO: 1378 - DNA, 21 bp, Homo sapiens
agagataaggctgccccatgg

SEQ ID NO: 1379 - DNA, 21 bp, Homo sapiens
cccacgatttagaaacctaaa

SEQ ID NO: 1380 - DNA, 21 bp, Homo sapiens
tggcccacgatttagaaacct

SEQ ID NO: 1381 - DNA, 21 bp, Homo sapiens
ccatggcccacgatttagaaa

SEQ ID NO: 1382 - DNA, 21 bp, Homo sapiens
gccccatggcccacgatttag

SEQ ID NO: 1383 - DNA, 21 bp, Homo sapiens
gataaggctgccccatggccc

SEQ ID NO: 1384 - DNA, 21 bp, Homo sapiens
gctgccccatggcccacgatt

SEQ ID NO: 1385 - DNA, 21 bp, Homo sapiens
aaggctgccccatggcccacg

SEQ ID NO: 1386 - DNA, 21 bp, Homo sapiens
agaaacctaaatcccaggccc

SEQ ID NO: 1387 - DNA, 21 bp, Homo sapiens
aacctaaatcccaggccccag

SEQ ID NO: 1388 - DNA, 21 bp, Homo sapiens
ctaaatcccaggccccagatg

SEQ ID NO: 1389 - DNA, 21 bp, Homo sapiens
aatcccaggccccagatgcca

SEQ ID NO: 1390 - DNA, 21 bp, Homo sapiens
caggccccagatgccaatctt

SEQ ID NO: 1391 - DNA, 21 bp, Homo sapiens
gatgccaatcttctggatcct

SEQ ID NO: 1392 - DNA, 21 bp, Homo sapiens
gccccagatgccaatcttctg

SEQ ID NO: 1393 - DNA, 21 bp, Homo sapiens
ccagatgccaatcttctggat

SEQ ID NO: 1394 - DNA, 21 bp, Homo sapiens
ctgggagcagaatggactgga

SEQ ID NO: 1395 - DNA, 21 bp, Homo sapiens
cccctgggagcagaatggact

SEQ ID NO: 1396 - DNA, 21 bp, Homo sapiens
ggagcagaatggactggaagt

SEQ ID NO: 1397 - DNA, 21 bp, Homo sapiens
gttcccctgggagcagaatgg

SEQ ID NO: 1398 - DNA, 21 bp, Homo sapiens
ccggttcccctgggagcagaa

SEQ ID NO: 1399 - DNA, 21 bp, Homo sapiens
tgggagcagaatggactggaa

SEQ ID NO: 1400 - DNA, 21 bp, Homo sapiens
ccctgggagcagaatggactg

SEQ ID NO: 1401 - DNA, 21 bp, Homo sapiens
ctggaagtttgggagggccag

SEQ ID NO: 1402 - DNA, 21 bp, Homo sapiens
gaagtttgggagggccagatt

SEQ ID NO: 1403 - DNA, 21 bp, Homo sapiens
gtttgggagggccagattcac

SEQ ID NO: 1404 - DNA, 21 bp, Homo sapiens
gagcagaatggactggaagtt

SEQ ID NO: 1405 - DNA, 21 bp, Homo sapiens
aatggactggaagtttgggag

SEQ ID NO: 1406 - DNA, 21 bp, Homo sapiens
ggactggaagtttgggagggc

SEQ ID NO: 1407 - DNA, 21 bp, Homo sapiens
cagaatggactggaagtttgg

SEQ ID NO: 1408 - DNA, 21 bp, Homo sapiens
cctgggagcagaatggactgg

SEQ ID NO: 1409 - DNA, 21 bp, Homo sapiens
gggagcagaatggactggaag

SEQ ID NO: 1410 - protein, 209 aa, Artificial Sequence
  source: /note="Description of Artificial Sequence: Synthetic polypeptide"
LEPGEKPYKCPECGKSFSTSHSLTEHQRTHTGEKPYKCPECGKSFSRSDKLVRHQRTHTGEKPYKCPECGKSFSTKNSLTEHQRTHTGEKPYKCPECGKSFSRADNLTEHQRTHTGEKPYKCPECGKSFSERSHLREHQRTHTGEKPYKCPECGKSFSRSDHLTTHQRTHTGEKPYKCPECGKSFSQLAHLRAHQRTHTGEKPTGKKTS

SEQ ID NO: 1411 - protein, 209 aa, Artificial Sequence
  source: /note="Description of Artificial Sequence: Synthetic polypeptide"
LEPGEKPYKCPECGKSFSRNDALTEHQRTHTGEKPYKCPECGKSFSSPADLTRHQRTHTGEKPYKCPECGKSFSQSSNLVRHQRTHTGEKPYKCPECGKSFSTSHSLTEHQRTHTGEKPYKCPECGKSFSRSDKLVRHQRTHTGEKPYKCPECGKSFSTKNSLTEHQRTHTGEKPYKCPECGKSFSRADNLTEHQRTHTGEKPTGKKTS

SEQ ID NO: 1412 - protein, 209 aa, Artificial Sequence
  source: /note="Description of Artificial Sequence: Synthetic polypeptide"
LEPGEKPYKCPECGKSFSSPADLTRHQRTHTGEKPYKCPECGKSFSQSSNLVRHQRTHTGEKPYKCPECGKSFSTSHSLTEHQRTHTGEKPYKCPECGKSFSRSDKLVRHQRTHTGEKPYKCPECGKSFSTKNSLTEHQRTHTGEKPYKCPECGKSFSRADNLTEHQRTHTGEKPYKCPECGKSFSERSHLREHQRTHTGEKPTGKKTS

SEQ ID NO: 1413 - protein, 209 aa, Artificial Sequence
  source: /note="Description of Artificial Sequence: Synthetic polypeptide"
LEPGEKPYKCPECGKSFSQSSNLVRHQRTHTGEKPYKCPECGKSFSTSHSLTEHQRTHTGEKPYKCPECGKSFSRSDKLVRHQRTHTGEKPYKCPECGKSFSTKNSLTEHQRTHTGEKPYKCPECGKSFSRADNLTEHQRTHTGEKPYKCPECGKSFSERSHLREHQRTHTGEKPYKCPECGKSFSRSDHLTTHQRTHTGEKPTGKKTS

SEQ ID NO: 1414 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSTKNSLTEHQRTHTGEKPYKCPECGKSFSRADNLTEHQRTHTGEKPYKCPECGKSFSERSHLREHQRTHTGEKPYKCPECGKSFSRSDHLTTHQRTHTGEKPYKCPECGKSFSQLAHLRAHQRTHTGEKPYKCPECGKSFSRNDTLTEHQRTHTGEKPTGKKTS

SEQ ID NO: 1415 - protein, 209 aa, Artificial Sequence
  source: /note="Description of Artificial Sequence: Synthetic polypeptide"
LEPGEKPYKCPECGKSFSTKNSLTEHQRTHTGEKPYKCPECGKSFSRADNLTEHQRTHTGEKPYKCPECGKSFSERSHLREHQRTHTGEKPYKCPECGKSFSRSDHLTTHQRTHTGEKPYKCPECGKSFSQLAHLRAHQRTHTGEKPYKCPECGKSFSRNDTLTEHQRTHTGEKPYKCPECGKSFSTTGNLTVHQRTHTGEKPTGKKTS

SEQ ID NO: 1416 - protein, 209 aa, Artificial Sequence
  source: /note="Description of Artificial Sequence: Synthetic polypeptide"
LEPGEKPYKCPECGKSFSTTGNLTVHQRTHTGEKPYKCPECGKSFSQSSNLVRHQRTHTGEKPYKCPECGKSFSRSDHLTTHQRTHTGEKPYKCPECGKSFSQAGHLASHQRTHTGEKPYKCPECGKSFSRRDELNVHQRTHTGEKPYKCPECGKSFSQLAHLRAHQRTHTGEKPYKCPECGKSFSRSDHLTNHQRTHTGEKPTGKKTS

SEQ ID NO: 1417 - protein, 209 aa, Artificial Sequence
  source: /note="Description of Artificial Sequence: Synthetic polypeptide"
LEPGEKPYKCPECGKSFSQSSNLVRHQRTHTGEKPYKCPECGKSFSRSDHLTTHQRTHTGEKPYKCPECGKSFSQAGHLASHQRTHTGEKPYKCPECGKSFSRRDELNVHQRTHTGEKPYKCPECGKSFSQLAHLRAHQRTHTGEKPYKCPECGKSFSRSDHLTNHQRTHTGEKPYKCPECGKSFSDSGNLRVHQRTHTGEKPTGKKTS

SEQ ID NO: 1418 - protein, 209 aa, Artificial Sequence
  source: /note="Description of Artificial Sequence: Synthetic polypeptide"
LEPGEKPYKCPECGKSFSRSDHLTTHQRTHTGEKPYKCPECGKSFSQLAHLRAHQRTHTGEKPYKCPECGKSFSRNDTLTEHQRTHTGEKPYKCPECGKSFSTTGNLTVHQRTHTGEKPYKCPECGKSFSQSSNLVRHQRTHTGEKPYKCPECGKSFSRSDHLTTHQRTHTGEKPYKCPECGKSFSQAGHLASHQRTHTGEKPTGKKTS

SEQ ID NO: 1419 - protein, 209 aa, Artificial Sequence
  source: /note="Description of Artificial Sequence: Synthetic polypeptide"
LEPGEKPYKCPECGKSFSRADNLTEHQRTHTGEKPYKCPECGKSFSERSHLREHQRTHTGEKPYKCPECGKSFSRSDHLTTHQRTHTGEKPYKCPECGKSFSQLAHLRAHQRTHTGEKPYKCPECGKSFSRNDTLTEHQRTHTGEKPYKCPECGKSFSTTGNLTVHQRTHTGEKPYKCPECGKSFSQSSNLVRHQRTHTGEKPTGKKTS

SEQ ID NO: 1420 - protein, 209 aa, Artificial Sequence
  source: /note="Description of Artificial Sequence: Synthetic polypeptide"
LEPGEKPYKCPECGKSFSERSHLREHQRTHTGEKPYKCPECGKSFSRSDHLTTHQRTHTGEKPYKCPECGKSFSQLAHLRAHQRTHTGEKPYKCPECGKSFSRNDTLTEHQRTHTGEKPYKCPECGKSFSTTGNLTVHQRTHTGEKPYKCPECGKSFSQSSNLVRHQRTHTGEKPYKCPECGKSFSRSDHLTTHQRTHTGEKPTGKKTS

SEQ ID NO: 1421 - protein, 209 aa, Artificial Sequence
  source: /note="Description of Artificial Sequence: Synthetic polypeptide"
LEPGEKPYKCPECGKSFSQRAHLERHQRTHTGEKPYKCPECGKSFSRNDALTEHQRTHTGEKPYKCPECGKSFSSPADLTRHQRTHTGEKPYKCPECGKSFSQSSNLVRHQRTHTGEKPYKCPECGKSFSTSHSLTEHQRTHTGEKPYKCPECGKSFSRSDKLVRHQRTHTGEKPYKCPECGKSFSTKNSLTEHQRTHTGEKPTGKKTS

SEQ ID NO: 1422 - protein, 209 aa, Artificial Sequence
  source: /note="Description of Artificial Sequence: Synthetic polypeptide"
LEPGEKPYKCPECGKSFSRSDELVRHQRTHTGEKPYKCPECGKSFSTSGELVRHQRTHTGEKPYKCPECGKSFSQRAHLERHQRTHTGEKPYKCPECGKSFSRNDALTEHQRTHTGEKPYKCPECGKSFSSPADLTRHQRTHTGEKPYKCPECGKSFSQSSNLVRHQRTHTGEKPYKCPECGKSFSTSHSLTEHQRTHTGEKPTGKKTS

SEQ ID NO: 1423 - protein, 209 aa, Artificial Sequence
  source: /note="Description of Artificial Sequence: Synthetic polypeptide"
LEPGEKPYKCPECGKSFSTSGELVRHQRTHTGEKPYKCPECGKSFSQRAHLERHQRTHTGEKPYKCPECGKSFSRNDALTEHQRTHTGEKPYKCPECGKSFSSPADLTRHQRTHTGEKPYKCPECGKSFSQSSNLVRHQRTHTGEKPYKCPECGKSFSTSHSLTEHQRTHTGEKPYKCPECGKSFSRSDKLVRHQRTHTGEKPTGKKTS

SEQ ID NO: 1424 - protein, 209 aa, Artificial Sequence
  source: /note="Description of Artificial Sequence: Synthetic polypeptide"
LEPGEKPYKCPECGKSFSQAGHLASHQRTHTGEKPYKCPECGKSFSRRDELNVHQRTHTGEKPYKCPECGKSFSQLAHLRAHQRTHTGEKPYKCPECGKSFSRSDHLTNHQRTHTGEKPYKCPECGKSFSDSGNLRVHQRTHTGEKPYKCPECGKSFSQRAHLERHQRTHTGEKPYKCPECGKSFSRSDNLVRHQRTHTGEKPTGKKTS

SEQ ID NO: 1425 - protein, 209 aa, Artificial Sequence
  source: /note="Description of Artificial Sequence: Synthetic polypeptide"
LEPGEKPYKCPECGKSFSRSDHLTTHQRTHTGEKPYKCPECGKSFSQAGHLASHQRTHTGEKPYKCPECGKSFSRRDELNVHQRTHTGEKPYKCPECGKSFSQLAHLRAHQRTHTGEKPYKCPECGKSFSRSDHLTNHQRTHTGEKPYKCPECGKSFSDSGNLRVHQRTHTGEKPYKCPECGKSFSQRAHLERHQRTHTGEKPTGKKTS

SEQ ID NO: 1426 - protein, 209 aa, Artificial Sequence
  source: /note="Description of Artificial Sequence: Synthetic polypeptide"
LEPGEKPYKCPECGKSFSQLAHLRAHQRTHTGEKPYKCPECGKSFSRNDTLTEHQRTHTGEKPYKCPECGKSFSTTGNLTVHQRTHTGEKPYKCPECGKSFSQSSNLVRHQRTHTGEKPYKCPECGKSFSRSDHLTTHQRTHTGEKPYKCPECGKSFSQAGHLASHQRTHTGEKPYKCPECGKSFSRRDELNVHQRTHTGEKPTGKKTS

SEQ ID NO: 1427 - protein, 209 aa, Artificial Sequence
  source: /note="Description of Artificial Sequence: Synthetic polypeptide"
LEPGEKPYKCPECGKSFSRNDTLTEHQRTHTGEKPYKCPECGKSFSTTGNLTVHQRTHTGEKPYKCPECGKSFSQSSNLVRHQRTHTGEKPYKCPECGKSFSRSDHLTTHQRTHTGEKPYKCPECGKSFSQAGHLASHQRTHTGEKPYKCPECGKSFSRRDELNVHQRTHTGEKPYKCPECGKSFSQLAHLRAHQRTHTGEKPTGKKTS

SEQ ID NO: 1428 - protein, 209 aa, Artificial Sequence
  source: /note="Description of Artificial Sequence: Synthetic polypeptide"
LEPGEKPYKCPECGKSFSQRAHLERHQRTHTGEKPYKCPECGKSFSRSDELVRHQRTHTGEKPYKCPECGKSFSTSGELVRHQRTHTGEKPYKCPECGKSFSQRAHLERHQRTHTGEKPYKCPECGKSFSRNDALTEHQRTHTGEKPYKCPECGKSFSSPADLTRHQRTHTGEKPYKCPECGKSFSQSSNLVRHQRTHTGEKPTGKKTS

SEQ ID NO: 1429 - protein, 209 aa, Artificial Sequence
  source: /note="Description of Artificial Sequence: Synthetic polypeptide"
LEPGEKPYKCPECGKSFSRADNLTEHQRTHTGEKPYKCPECGKSFSRSDKLVRHQRTHTGEKPYKCPECGKSFSRSDNLVRHQRTHTGEKPYKCPECGKSFSQRAHLERHQRTHTGEKPYKCPECGKSFSDPGNLVRHQRTHTGEKPYKCPECGKSFSQRAHLERHQRTHTGEKPYKCPECGKSFSRSDELVRHQRTHTGEKPTGKKTS

SEQ ID NO: 1430 - protein, 209 aa, Artificial Sequence
  source: /note="Description of Artificial Sequence: Synthetic polypeptide"
LEPGEKPYKCPECGKSFSDPGNLVRHQRTHTGEKPYKCPECGKSFSQRAHLERHQRTHTGEKPYKCPECGKSFSRSDELVRHQRTHTGEKPYKCPECGKSFSTSGELVRHQRTHTGEKPYKCPECGKSFSQRAHLERHQRTHTGEKPYKCPECGKSFSRNDALTEHQRTHTGEKPYKCPECGKSFSSPADLTRHQRTHTGEKPTGKKTS

SEQ ID NO: 1431 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSRSDNLVRHQRTHTGEKPYKCPECGKSFSQRAHLERHQRTHTGEKPYKCPECGKSFSDPGNLVRHQRTHTGEKPYKCPECGKSFSQRAHLERHQRTHTGEKPYKCPECGKSFSRSDELVRHQRTHTGEKPYKCPECGKSFSTSGELVRHQRTHTGEKPTGKKTS

SEQ ID NO: 1432 - protein, 209 aa, Artificial Sequence
  source: /note="Description of Artificial Sequence: Synthetic polypeptide"
LEPGEKPYKCPECGKSFSQRAHLERHQRTHTGEKPYKCPECGKSFSDPGNLVRHQRTHTGEKPYKCPECGKSFSQRAHLERHQRTHTGEKPYKCPECGKSFSRSDELVRHQRTHTGEKPYKCPECGKSFSTSGELVRHQRTHTGEKPYKCPECGKSFSQRAHLERHQRTHTGEKPYKCPECGKSFSRNDALTEHQRTHTGEKPTGKKTS

SEQ ID NO: 1433 - protein, 209 aa, Artificial Sequence
  source: /note="Description of Artificial Sequence: Synthetic polypeptide"
LEPGEKPYKCPECGKSFSRSDNLVRHQRTHTGEKPYKCPECGKSFSQRAHLERHQRTHTGEKPYKCPECGKSFSDPGNLVRHQRTHTGEKPYKCPECGKSFSQRAHLERHQRTHTGEKPYKCPECGKSFSRSDELVRHQRTHTGEKPYKCPECGKSFSTSGELVRHQRTHTGEKPYKCPECGKSFSQRAHLERHQRTHTGEKPTGKKTS

SEQ ID NO: 1434 - protein, 209 aa, Artificial Sequence
  source: /note="Description of Artificial Sequence: Synthetic polypeptide"
LEPGEKPYKCPECGKSFSQLAHLRAHQRTHTGEKPYKCPECGKSFSRSDHLTNHQRTHTGEKPYKCPECGKSFSDSGNLRVHQRTHTGEKPYKCPECGKSFSQRAHLERHQRTHTGEKPYKCPECGKSFSRSDNLVRHQRTHTGEKPYKCPECGKSFSTSGHLVRHQRTHTGEKPYKCPECGKSFSRSDKLVRHQRTHTGEKPTGKKTS

SEQ ID NO: 1435 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSTSGHLVRHQRTHTGEKPYKCPECGKSFSRADNLTEHQRTHTGEKPYKCPECGKSFSRSDKLVRHQRTHTGEKPYKCPECGKSFSRSDNLVRHQRTHTGEKPYKCPECGKSFSQRAHLERHQRTHTGEKPYKCPECGKSFSDPGNLVRHQRTHTGEKPTGKKTS

SEQ ID NO: 1436 - protein, 209 aa, Artificial Sequence
  source: /note="Description of Artificial Sequence: Synthetic polypeptide"
LEPGEKPYKCPECGKSFSRRDELNVHQRTHTGEKPYKCPECGKSFSQLAHLRAHQRTHTGEKPYKCPECGKSFSRSDHLTNHQRTHTGEKPYKCPECGKSFSDSGNLRVHQRTHTGEKPYKCPECGKSFSQRAHLERHQRTHTGEKPYKCPECGKSFSRSDNLVRHQRTHTGEKPYKCPECGKSFSTSGHLVRHQRTHTGEKPTGKKTS

SEQ ID NO: 1437 - protein, 209 aa, Artificial Sequence
  source: /note="Description of Artificial Sequence: Synthetic polypeptide"
LEPGEKPYKCPECGKSFSTSGHLVRHQRTHTGEKPYKCPECGKSFSRADNLTEHQRTHTGEKPYKCPECGKSFSRSDKLVRHQRTHTGEKPYKCPECGKSFSRSDNLVRHQRTHTGEKPYKCPECGKSFSQRAHLERHQRTHTGEKPYKCPECGKSFSDPGNLVRHQRTHTGEKPYKCPECGKSFSQRAHLERHQRTHTGEKPTGKKTS

SEQ ID NO: 1438 - protein, 209 aa, Artificial Sequence
  source: /note="Description of Artificial Sequence: Synthetic polypeptide"
LEPGEKPYKCPECGKSFSDSGNLRVHQRTHTGEKPYKCPECGKSFSQRAHLERHQRTHTGEKPYKCPECGKSFSRSDNLVRHQRTHTGEKPYKCPECGKSFSTSGHLVRHQRTHTGEKPYKCPECGKSFSRSDKLVRHQRTHTGEKPYKCPECGKSFSTSGHLVRHQRTHTGEKPYKCPECGKSFSRSDKLVRHQRTHTGEKPTGKKTS

SEQ ID NO: 1439 - protein, 209 aa, Artificial Sequence
  source: /note="Description of Artificial Sequence: Synthetic polypeptide"
LEPGEKPYKCPECGKSFSRSDHLTNHQRTHTGEKPYKCPECGKSFSDSGNLRVHQRTHTGEKPYKCPECGKSFSQRAHLERHQRTHTGEKPYKCPECGKSFSRSDNLVRHQRTHTGEKPYKCPECGKSFSTSGHLVRHQRTHTGEKPYKCPECGKSFSRSDKLVRHQRTHTGEKPYKCPECGKSFSTSGHLVRHQRTHTGEKPTGKKTS

SEQ ID NO: 1440 - protein, 209 aa, Artificial Sequence
  source: /note="Description of Artificial Sequence: Synthetic polypeptide"
LEPGEKPYKCPECGKSFSQRAHLERHQRTHTGEKPYKCPECGKSFSRSDNLVRHQRTHTGEKPYKCPECGKSFSTSGHLVRHQRTHTGEKPYKCPECGKSFSRSDKLVRHQRTHTGEKPYKCPECGKSFSTSGHLVRHQRTHTGEKPYKCPECGKSFSRSDKLVRHQRTHTGEKPYKCPECGKSFSQRAHLERHQRTHTGEKPTGKKTS

SEQ ID NO: 1441 - protein, 209 aa, Artificial Sequence
  source: /note="Description of Artificial Sequence: Synthetic polypeptide"
LEPGEKPYKCPECGKSFSRSDNLVRHQRTHTGEKPYKCPECGKSFSTSGHLVRHQRTHTGEKPYKCPECGKSFSRSDKLVRHQRTHTGEKPYKCPECGKSFSTSGHLVRHQRTHTGEKPYKCPECGKSFSRSDKLVRHQRTHTGEKPYKCPECGKSFSQRAHLERHQRTHTGEKPYKCPECGKSFSRNDTLTEHQRTHTGEKPTGKKTS

SEQ ID NO: 1442 - protein, 209 aa, Artificial Sequence
  source: /note="Description of Artificial Sequence: Synthetic polypeptide"
LEPGEKPYKCPECGKSFSRSDHLTNHQRTHTGEKPYKCPECGKSFSRSDELVRHQRTHTGEKPYKCPECGKSFSRSDKLVRHQRTHTGEKPYKCPECGKSFSRSDELVRHQRTHTGEKPYKCPECGKSFSRSDKLVRHQRTHTGEKPYKCPECGKSFSRSDNLVRHQRTHTGEKPYKCPECGKSFSRSDKLTEHQRTHTGEKPTGKKTS

SEQ ID NO: 1443 - protein, 209 aa, Artificial Sequence
  source: /note="Description of Artificial Sequence: Synthetic polypeptide"
LEPGEKPYKCPECGKSFSQSSNLVRHQRTHTGEKPYKCPECGKSFSRSDHLTNHQRTHTGEKPYKCPECGKSFSRSDELVRHQRTHTGEKPYKCPECGKSFSRSDKLVRHQRTHTGEKPYKCPECGKSFSRSDELVRHQRTHTGEKPYKCPECGKSFSRSDKLVRHQRTHTGEKPYKCPECGKSFSRSDNLVRHQRTHTGEKPTGKKTS

SEQ ID NO: 1444 - protein, 209 aa, Artificial Sequence
  source: /note="Description of Artificial Sequence: Synthetic polypeptide"
LEPGEKPYKCPECGKSFSSPADLTRHQRTHTGEKPYKCPECGKSFSQSSNLVRHQRTHTGEKPYKCPECGKSFSRSDHLTNHQRTHTGEKPYKCPECGKSFSRSDELVRHQRTHTGEKPYKCPECGKSFSRSDKLVRHQRTHTGEKPYKCPECGKSFSRSDELVRHQRTHTGEKPYKCPECGKSFSRSDKLVRHQRTHTGEKPTGKKTS

SEQ ID NO: 1445 - protein, 209 aa, Artificial Sequence
  source: /note="Description of Artificial Sequence: Synthetic polypeptide"
LEPGEKPYKCPECGKSFSQRAHLERHQRTHTGEKPYKCPECGKSFSSPADLTRHQRTHTGEKPYKCPECGKSFSQSSNLVRHQRTHTGEKPYKCPECGKSFSRSDHLTNHQRTHTGEKPYKCPECGKSFSRSDELVRHQRTHTGEKPYKCPECGKSFSRSDKLVRHQRTHTGEKPYKCPECGKSFSRSDELVRHQRTHTGEKPTGKKTS

SEQ ID NO: 1446 - protein, 209 aa, Artificial Sequence
  source: /note="Description of Artificial Sequence: Synthetic polypeptide"
LEPGEKPYKCPECGKSFSQSSNLVRHQRTHTGEKPYKCPECGKSFSQRAHLERHQRTHTGEKPYKCPECGKSFSSPADLTRHQRTHTGEKPYKCPECGKSFSQSSNLVRHQRTHTGEKPYKCPECGKSFSRSDHLTNHQRTHTGEKPYKCPECGKSFSRSDELVRHQRTHTGEKPYKCPECGKSFSRSDKLVRHQRTHTGEKPTGKKTS

SEQ ID NO: 1447 - protein, 209 aa, Artificial Sequence
  source: /note="Description of Artificial Sequence: Synthetic polypeptide"
LEPGEKPYKCPECGKSFSTTGNLTVHQRTHTGEKPYKCPECGKSFSRSDNLVRHQRTHTGEKPYKCPECGKSFSRADNLTEHQRTHTGEKPYKCPECGKSFSQRANLRAHQRTHTGEKPYKCPECGKSFSRSDKLVRHQRTHTGEKPYKCPECGKSFSQAGHLASHQRTHTGEKPYKCPECGKSFSRSDKLVRHQRTHTGEKPTGKKTS

SEQ ID NO: 1448 - protein, 209 aa, Artificial Sequence
  source: /note="Description of Artificial Sequence: Synthetic polypeptide"
LEPGEKPYKCPECGKSFSRADNLTEHQRTHTGEKPYKCPECGKSFSQRANLRAHQRTHTGEKPYKCPECGKSFSRSDKLVRHQRTHTGEKPYKCPECGKSFSQAGHLASHQRTHTGEKPYKCPECGKSFSRSDKLVRHQRTHTGEKPYKCPECGKSFSRSDHLTTHQRTHTGEKPYKCPECGKSFSRSDKLVRHQRTHTGEKPTGKKTS

SEQ ID NO: 1449 - protein, 209 aa, Artificial Sequence
  source: /note="Description of Artificial Sequence: Synthetic polypeptide"
LEPGEKPYKCPECGKSFSRSDELVRHQRTHTGEKPYKCPECGKSFSTTGNLTVHQRTHTGEKPYKCPECGKSFSRSDNLVRHQRTHTGEKPYKCPECGKSFSRADNLTEHQRTHTGEKPYKCPECGKSFSQRANLRAHQRTHTGEKPYKCPECGKSFSRSDKLVRHQRTHTGEKPYKCPECGKSFSQAGHLASHQRTHTGEKPTGKKTS

SEQ ID NO: 1450 - protein, 209 aa, Artificial Sequence
  source: /note="Description of Artificial Sequence: Synthetic polypeptide"
LEPGEKPYKCPECGKSFSRSDNLVRHQRTHTGEKPYKCPECGKSFSRADNLTEHQRTHTGEKPYKCPECGKSFSQRANLRAHQRTHTGEKPYKCPECGKSFSRSDKLVRHQRTHTGEKPYKCPECGKSFSQAGHLASHQRTHTGEKPYKCPECGKSFSRSDKLVRHQRTHTGEKPYKCPECGKSFSRSDHLTTHQRTHTGEKPTGKKTS

SEQ ID NO: 1451 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSQAGHLASHQRTHTGEKPYKCPECGKSFSRSDKLVRHQRTHTGEKPYKCPECGKSFSRSDHLTTHQRTHTGEKPYKCPECGKSFSRSDKLVRHQRTHTGEKPYKCPECGKSFSRSDHLTNHQRTHTGEKPYKCPECGKSFSRSDKLVRHQRTHTGEKPTGKKTS

SEQ ID NO: 1452 - protein, 209 aa, Artificial Sequence
  source: /note="Description of Artificial Sequence: Synthetic polypeptide"
LEPGEKPYKCPECGKSFSQRANLRAHQRTHTGEKPYKCPECGKSFSRSDKLVRHQRTHTGEKPYKCPECGKSFSQAGHLASHQRTHTGEKPYKCPECGKSFSRSDKLVRHQRTHTGEKPYKCPECGKSFSRSDHLTTHQRTHTGEKPYKCPECGKSFSRSDKLVRHQRTHTGEKPYKCPECGKSFSRSDHLTNHQRTHTGEKPTGKKTS

SEQ ID NO: 1453 - protein, 209 aa, Artificial Sequence
  source: /note="Description of Artificial Sequence: Synthetic polypeptide"
LEPGEKPYKCPECGKSFSRRDELNVHQRTHTGEKPYKCPECGKSFSRSDELVRHQRTHTGEKPYKCPECGKSFSTTGNLTVHQRTHTGEKPYKCPECGKSFSRSDNLVRHQRTHTGEKPYKCPECGKSFSRADNLTEHQRTHTGEKPYKCPECGKSFSQRANLRAHQRTHTGEKPYKCPECGKSFSRSDKLVRHQRTHTGEKPTGKKTS

SEQ ID NO: 1454 - protein, 209 aa, Artificial Sequence
  source: /note="Description of Artificial Sequence: Synthetic polypeptide"
LEPGEKPYKCPECGKSFSQRAHLERHQRTHTGEKPYKCPECGKSFSRRDELNVHQRTHTGEKPYKCPECGKSFSRSDELVRHQRTHTGEKPYKCPECGKSFSTTGNLTVHQRTHTGEKPYKCPECGKSFSRSDNLVRHQRTHTGEKPYKCPECGKSFSRADNLTEHQRTHTGEKPYKCPECGKSFSQRANLRAHQRTHTGEKPTGKKTS

SEQ ID NO: 1455 - protein, 209 aa, Artificial Sequence
  source: /note="Description of Artificial Sequence: Synthetic polypeptide"
LEPGEKPYKCPECGKSFSQRANLRAHQRTHTGEKPYKCPECGKSFSQRAHLERHQRTHTGEKPYKCPECGKSFSRRDELNVHQRTHTGEKPYKCPECGKSFSRSDELVRHQRTHTGEKPYKCPECGKSFSTTGNLTVHQRTHTGEKPYKCPECGKSFSRSDNLVRHQRTHTGEKPYKCPECGKSFSRADNLTEHQRTHTGEKPTGKKTS

SEQ ID NO: 1456 - protein, 209 aa, Artificial Sequence
  source: /note="Description of Artificial Sequence: Synthetic polypeptide"
LEPGEKPYKCPECGKSFSRNDALTEHQRTHTGEKPYKCPECGKSFSRSDNLVRHQRTHTGEKPYKCPECGKSFSRSDHLTTHQRTHTGEKPYKCPECGKSFSSKKALTEHQRTHTGEKPYKCPECGKSFSQRANLRAHQRTHTGEKPYKCPECGKSFSRADNLTEHQRTHTGEKPYKCPECGKSFSDPGHLVRHQRTHTGEKPTGKKTS

SEQ ID NO: 1457 - protein, 209 aa, Artificial Sequence
  source: /note="Description of Artificial Sequence: Synthetic polypeptide"
LEPGEKPYKCPECGKSFSRSDNLVRHQRTHTGEKPYKCPECGKSFSRSDHLTTHQRTHTGEKPYKCPECGKSFSSKKALTEHQRTHTGEKPYKCPECGKSFSQRANLRAHQRTHTGEKPYKCPECGKSFSRADNLTEHQRTHTGEKPYKCPECGKSFSDPGHLVRHQRTHTGEKPYKCPECGKSFSRNDALTEHQRTHTGEKPTGKKTS

SEQ ID NO: 1458 - protein, 209 aa, Artificial Sequence
  source: /note="Description of Artificial Sequence: Synthetic polypeptide"
LEPGEKPYKCPECGKSFSRSDNLVRHQRTHTGEKPYKCPECGKSFSRSDHLTTHQRTHTGEKPYKCPECGKSFSRNDALTEHQRTHTGEKPYKCPECGKSFSRSDNLVRHQRTHTGEKPYKCPECGKSFSRSDHLTTHQRTHTGEKPYKCPECGKSFSSKKALTEHQRTHTGEKPYKCPECGKSFSQRANLRAHQRTHTGEKPTGKKTS

SEQ ID NO: 1459 - protein, 209 aa, Artificial Sequence
  source: /note="Description of Artificial Sequence: Synthetic polypeptide"
LEPGEKPYKCPECGKSFSSKKALTEHQRTHTGEKPYKCPECGKSFSQRANLRAHQRTHTGEKPYKCPECGKSFSRADNLTEHQRTHTGEKPYKCPECGKSFSDPGHLVRHQRTHTGEKPYKCPECGKSFSRNDALTEHQRTHTGEKPYKCPECGKSFSERSHLREHQRTHTGEKPYKCPECGKSFSDCRDLARHQRTHTGEKPTGKKTS

SEQ ID NO: 1460 - protein, 209 aa, Artificial Sequence
  source: /note="Description of Artificial Sequence: Synthetic polypeptide"
LEPGEKPYKCPECGKSFSRSDHLTTHQRTHTGEKPYKCPECGKSFSSKKALTEHQRTHTGEKPYKCPECGKSFSQRANLRAHQRTHTGEKPYKCPECGKSFSRADNLTEHQRTHTGEKPYKCPECGKSFSDPGHLVRHQRTHTGEKPYKCPECGKSFSRNDALTEHQRTHTGEKPYKCPECGKSFSERSHLREHQRTHTGEKPTGKKTS

SEQ ID NO: 1461 - protein, 209 aa, Artificial Sequence
  source: /note="Description of Artificial Sequence: Synthetic polypeptide"
LEPGEKPYKCPECGKSFSRSDHLTTHQRTHTGEKPYKCPECGKSFSRNDALTEHQRTHTGEKPYKCPECGKSFSRSDNLVRHQRTHTGEKPYKCPECGKSFSRSDHLTTHQRTHTGEKPYKCPECGKSFSSKKALTEHQRTHTGEKPYKCPECGKSFSQRANLRAHQRTHTGEKPYKCPECGKSFSRADNLTEHQRTHTGEKPTGKKTS

SEQ ID NO: 1462 - protein, 209 aa, Artificial Sequence
  source: /note="Description of Artificial Sequence: Synthetic polypeptide"
LEPGEKPYKCPECGKSFSRADNLTEHQRTHTGEKPYKCPECGKSFSDPGHLVRHQRTHTGEKPYKCPECGKSFSRNDALTEHQRTHTGEKPYKCPECGKSFSERSHLREHQRTHTGEKPYKCPECGKSFSDCRDLARHQRTHTGEKPYKCPECGKSFSQRAHLERHQRTHTGEKPYKCPECGKSFSTSGNLVRHQRTHTGEKPTGKKTS

SEQ ID NO: 1463 - protein, 209 aa, Artificial Sequence
  source: /note="Description of Artificial Sequence: Synthetic polypeptide"
LEPGEKPYKCPECGKSFSQRANLRAHQRTHTGEKPYKCPECGKSFSRADNLTEHQRTHTGEKPYKCPECGKSFSDPGHLVRHQRTHTGEKPYKCPECGKSFSRNDALTEHQRTHTGEKPYKCPECGKSFSERSHLREHQRTHTGEKPYKCPECGKSFSDCRDLARHQRTHTGEKPYKCPECGKSFSQRAHLERHQRTHTGEKPTGKKTS

SEQ ID NO: 1464 - protein, 209 aa, Artificial Sequence
  source: /note="Description of Artificial Sequence: Synthetic polypeptide"
LEPGEKPYKCPECGKSFSRSDNLVRHQRTHTGEKPYKCPECGKSFSRTDTLRDHQRTHTGEKPYKCPECGKSFSRSDNLVRHQRTHTGEKPYKCPECGKSFSRSDHLTTHQRTHTGEKPYKCPECGKSFSRNDALTEHQRTHTGEKPYKCPECGKSFSRSDNLVRHQRTHTGEKPYKCPECGKSFSRSDHLTTHQRTHTGEKPTGKKTS

SEQ ID NO: 1465 - protein, 209 aa, Artificial Sequence
  source: /note="Description of Artificial Sequence: Synthetic polypeptide"
LEPGEKPYKCPECGKSFSRSDHLTNHQRTHTGEKPYKCPECGKSFSRSDNLVRHQRTHTGEKPYKCPECGKSFSRTDTLRDHQRTHTGEKPYKCPECGKSFSRSDNLVRHQRTHTGEKPYKCPECGKSFSRSDHLTTHQRTHTGEKPYKCPECGKSFSRNDALTEHQRTHTGEKPYKCPECGKSFSRSDNLVRHQRTHTGEKPTGKKTS

SEQ ID NO: 1466 - protein, 209 aa, Artificial Sequence
  source: /note="Description of Artificial Sequence: Synthetic polypeptide"
LEPGEKPYKCPECGKSFSDPGHLVRHQRTHTGEKPYKCPECGKSFSRSDHLTNHQRTHTGEKPYKCPECGKSFSRSDNLVRHQRTHTGEKPYKCPECGKSFSRTDTLRDHQRTHTGEKPYKCPECGKSFSRSDNLVRHQRTHTGEKPYKCPECGKSFSRSDHLTTHQRTHTGEKPYKCPECGKSFSRNDALTEHQRTHTGEKPTGKKTS

SEQ ID NO: 1467 - protein, 209 aa, Artificial Sequence
  source: /note="Description of Artificial Sequence: Synthetic polypeptide"
LEPGEKPYKCPECGKSFSRSDELVRHQRTHTGEKPYKCPECGKSFSRSDHLTNHQRTHTGEKPYKCPECGKSFSDPGHLVRHQRTHTGEKPYKCPECGKSFSRSDHLTNHQRTHTGEKPYKCPECGKSFSRSDNLVRHQRTHTGEKPYKCPECGKSFSRTDTLRDHQRTHTGEKPYKCPECGKSFSRSDNLVRHQRTHTGEKPTGKKTS

SEQ ID NO: 1468 - protein, 209 aa, Artificial Sequence
  source: /note="Description of Artificial Sequence: Synthetic polypeptide"
LEPGEKPYKCPECGKSFSRSDHLTNHQRTHTGEKPYKCPECGKSFSDPGHLVRHQRTHTGEKPYKCPECGKSFSRSDHLTNHQRTHTGEKPYKCPECGKSFSRSDNLVRHQRTHTGEKPYKCPECGKSFSRTDTLRDHQRTHTGEKPYKCPECGKSFSRSDNLVRHQRTHTGEKPYKCPECGKSFSRSDHLTTHQRTHTGEKPTGKKTS

SEQ ID NO: 1469 - protein, 209 aa, Artificial Sequence
  source: /note="Description of Artificial Sequence: Synthetic polypeptide"
LEPGEKPYKCPECGKSFSRTDTLRDHQRTHTGEKPYKCPECGKSFSRSDNLVRHQRTHTGEKPYKCPECGKSFSRSDHLTTHQRTHTGEKPYKCPECGKSFSRNDALTEHQRTHTGEKPYKCPECGKSFSRSDNLVRHQRTHTGEKPYKCPECGKSFSRSDHLTTHQRTHTGEKPYKCPECGKSFSSKKALTEHQRTHTGEKPTGKKTS

SEQ ID NO: 1470 - protein, 209 aa, Artificial Sequence
  source: /note="Description of Artificial Sequence: Synthetic polypeptide"
LEPGEKPYKCPECGKSFSQRAHLERHQRTHTGEKPYKCPECGKSFSRSDELVRHQRTHTGEKPYKCPECGKSFSRSDHLTNHQRTHTGEKPYKCPECGKSFSDPGHLVRHQRTHTGEKPYKCPECGKSFSRSDHLTNHQRTHTGEKPYKCPECGKSFSRSDNLVRHQRTHTGEKPYKCPECGKSFSRTDTLRDHQRTHTGEKPTGKKTS

SEQ ID NO: 1471 - protein, 209 aa, Artificial Sequence
  source: /note="Description of Artificial Sequence: Synthetic polypeptide"
LEPGEKPYKCPECGKSFSDPGHLVRHQRTHTGEKPYKCPECGKSFSRNDALTEHQRTHTGEKPYKCPECGKSFSERSHLREHQRTHTGEKPYKCPECGKSFSDCRDLARHQRTHTGEKPYKCPECGKSFSQRAHLERHQRTHTGEKPYKCPECGKSFSTSGNLVRHQRTHTGEKPYKCPECGKSFSQSGHLTEHQRTHTGEKPTGKKTS

SEQ ID NO: 1472 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSTHLDLIRHQRTHTGEKPYKCPECGKSFSDSGNLRVHQRTHTGEKPYKCPECGKSFSQLAHLRAHQRTHTGEKPYKCPECGKSFSDCRDLARHQRTHTGEKPYKCPECGKSFSRSDHLTTHQRTHTGEKPYKCPECGKSFSDCRDLARHQRTHTGEKPTGKKTS

SEQ ID NO: 1473 - protein, 209 aa, Artificial Sequence
  source: /note="Description of Artificial Sequence: Synthetic polypeptide"
LEPGEKPYKCPECGKSFSTHLDLIRHQRTHTGEKPYKCPECGKSFSDSGNLRVHQRTHTGEKPYKCPECGKSFSQLAHLRAHQRTHTGEKPYKCPECGKSFSDCRDLARHQRTHTGEKPYKCPECGKSFSRSDHLTTHQRTHTGEKPYKCPECGKSFSDCRDLARHQRTHTGEKPYKCPECGKSFSTSHSLTEHQRTHTGEKPTGKKTS

SEQ ID NO: 1474 - protein, 209 aa, Artificial Sequence
  source: /note="Description of Artificial Sequence: Synthetic polypeptide"
LEPGEKPYKCPECGKSFSERSHLREHQRTHTGEKPYKCPECGKSFSRSDKLVRHQRTHTGEKPYKCPECGKSFSTHLDLIRHQRTHTGEKPYKCPECGKSFSDSGNLRVHQRTHTGEKPYKCPECGKSFSQLAHLRAHQRTHTGEKPYKCPECGKSFSDCRDLARHQRTHTGEKPYKCPECGKSFSRSDHLTTHQRTHTGEKPTGKKTS

SEQ ID NO: 1475 - protein, 209 aa, Artificial Sequence
  source: /note="Description of Artificial Sequence: Synthetic polypeptide"
LEPGEKPYKCPECGKSFSDSGNLRVHQRTHTGEKPYKCPECGKSFSQLAHLRAHQRTHTGEKPYKCPECGKSFSDCRDLARHQRTHTGEKPYKCPECGKSFSRSDHLTTHQRTHTGEKPYKCPECGKSFSDCRDLARHQRTHTGEKPYKCPECGKSFSTSHSLTEHQRTHTGEKPYKCPECGKSFSRSDNLVRHQRTHTGEKPTGKKTS

SEQ ID NO: 1476 - protein, 209 aa, Artificial Sequence
  source: /note="Description of Artificial Sequence: Synthetic polypeptide"
LEPGEKPYKCPECGKSFSQLAHLRAHQRTHTGEKPYKCPECGKSFSDCRDLARHQRTHTGEKPYKCPECGKSFSRSDHLTTHQRTHTGEKPYKCPECGKSFSDCRDLARHQRTHTGEKPYKCPECGKSFSTSHSLTEHQRTHTGEKPYKCPECGKSFSRSDNLVRHQRTHTGEKPYKCPECGKSFSRRDELNVHQRTHTGEKPTGKKTS

SEQ ID NO: 1477 - protein, 209 aa, Artificial Sequence
  source: /note="Description of Artificial Sequence: Synthetic polypeptide"
LEPGEKPYKCPECGKSFSDCRDLARHQRTHTGEKPYKCPECGKSFSRSDHLTTHQRTHTGEKPYKCPECGKSFSDCRDLARHQRTHTGEKPYKCPECGKSFSTSHSLTEHQRTHTGEKPYKCPECGKSFSRSDNLVRHQRTHTGEKPYKCPECGKSFSRRDELNVHQRTHTGEKPYKCPECGKSFSRSDNLVRHQRTHTGEKPTGKKTS

SEQ ID NO: 1478 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSQSGDLRRHQRTHTGEKPYKCPECGKSFSRSDKLVRHQRTHTGEKPYKCPECGKSFSQLAHLRAHQRTHTGEKPYKCPECGKSFSRSDKLTEHQRTHTGEKPYKCPECGKSFSQLAHLRAHQRTHTGEKPYKCPECGKSFSRSDKLVRHQRTHTGEKPTGKKTS

SEQ ID NO: 1479 - protein, 209 aa, Artificial Sequence
  source: /note="Description of Artificial Sequence: Synthetic polypeptide"
LEPGEKPYKCPECGKSFSRSDHLTTHQRTHTGEKPYKCPECGKSFSRSDKLVRHQRTHTGEKPYKCPECGKSFSQSGDLRRHQRTHTGEKPYKCPECGKSFSRSDKLVRHQRTHTGEKPYKCPECGKSFSQLAHLRAHQRTHTGEKPYKCPECGKSFSRSDKLTEHQRTHTGEKPYKCPECGKSFSQLAHLRAHQRTHTGEKPTGKKTS

SEQ ID NO: 1480 - protein, 209 aa, Artificial Sequence
  source: /note="Description of Artificial Sequence: Synthetic polypeptide"
LEPGEKPYKCPECGKSFSTSGNLVRHQRTHTGEKPYKCPECGKSFSRSDHLTTHQRTHTGEKPYKCPECGKSFSRSDKLVRHQRTHTGEKPYKCPECGKSFSQSGDLRRHQRTHTGEKPYKCPECGKSFSRSDKLVRHQRTHTGEKPYKCPECGKSFSQLAHLRAHQRTHTGEKPYKCPECGKSFSRSDKLTEHQRTHTGEKPTGKKTS

SEQ ID NO: 1481 - protein, 209 aa, Artificial Sequence
  source: /note="Description of Artificial Sequence: Synthetic polypeptide"
LEPGEKPYKCPECGKSFSSKKALTEHQRTHTGEKPYKCPECGKSFSTSGNLVRHQRTHTGEKPYKCPECGKSFSRSDHLTTHQRTHTGEKPYKCPECGKSFSRSDKLVRHQRTHTGEKPYKCPECGKSFSQSGDLRRHQRTHTGEKPYKCPECGKSFSRSDKLVRHQRTHTGEKPYKCPECGKSFSQLAHLRAHQRTHTGEKPTGKKTS

SEQ ID NO: 1482 - protein, 209 aa, Artificial Sequence
  source: /note="Description of Artificial Sequence: Synthetic polypeptide"
LEPGEKPYKCPECGKSFSRSDKLTEHQRTHTGEKPYKCPECGKSFSRSDNLVRHQRTHTGEKPYKCPECGKSFSRADNLTEHQRTHTGEKPYKCPECGKSFSRSDNLVRHQRTHTGEKPYKCPECGKSFSRSDHLTNHQRTHTGEKPYKCPECGKSFSSKKALTEHQRTHTGEKPYKCPECGKSFSTSGNLVRHQRTHTGEKPTGKKTS

SEQ ID NO: 1483 - protein, 209 aa, Artificial Sequence
  source: /note="Description of Artificial Sequence: Synthetic polypeptide"
LEPGEKPYKCPECGKSFSRSDHLTNHQRTHTGEKPYKCPECGKSFSSKKALTEHQRTHTGEKPYKCPECGKSFSTSGNLVRHQRTHTGEKPYKCPECGKSFSRSDHLTTHQRTHTGEKPYKCPECGKSFSRSDKLVRHQRTHTGEKPYKCPECGKSFSQSGDLRRHQRTHTGEKPYKCPECGKSFSRSDKLVRHQRTHTGEKPTGKKTS

SEQ ID NO: 1484 - protein, 209 aa, Artificial Sequence
  source: /note="Description of Artificial Sequence: Synthetic polypeptide"
LEPGEKPYKCPECGKSFSRADNLTEHQRTHTGEKPYKCPECGKSFSRSDNLVRHQRTHTGEKPYKCPECGKSFSRSDHLTNHQRTHTGEKPYKCPECGKSFSSKKALTEHQRTHTGEKPYKCPECGKSFSTSGNLVRHQRTHTGEKPYKCPECGKSFSRSDHLTTHQRTHTGEKPYKCPECGKSFSRSDKLVRHQRTHTGEKPTGKKTS

SEQ ID NO: 1485 - protein, 209 aa, Artificial Sequence
  source: /note="Description of Artificial Sequence: Synthetic polypeptide"
LEPGEKPYKCPECGKSFSRSDNLVRHQRTHTGEKPYKCPECGKSFSRADNLTEHQRTHTGEKPYKCPECGKSFSRSDNLVRHQRTHTGEKPYKCPECGKSFSRSDHLTNHQRTHTGEKPYKCPECGKSFSSKKALTEHQRTHTGEKPYKCPECGKSFSTSGNLVRHQRTHTGEKPYKCPECGKSFSRSDHLTTHQRTHTGEKPTGKKTS

SEQ ID NO: 1486 - protein, 209 aa, Artificial Sequence
  source: /note="Description of Artificial Sequence: Synthetic polypeptide"
LEPGEKPYKCPECGKSFSRSDNLVRHQRTHTGEKPYKCPECGKSFSRSDHLTNHQRTHTGEKPYKCPECGKSFSSKKALTEHQRTHTGEKPYKCPECGKSFSTSGNLVRHQRTHTGEKPYKCPECGKSFSRSDHLTTHQRTHTGEKPYKCPECGKSFSRSDKLVRHQRTHTGEKPYKCPECGKSFSQSGDLRRHQRTHTGEKPTGKKTS

SEQ ID NO: 1487 - protein, 209 aa, Artificial Sequence
  source: /note="Description of Artificial Sequence: Synthetic polypeptide"
LEPGEKPYKCPECGKSFSHKNALQNHQRTHTGEKPYKCPECGKSFSQRAHLERHQRTHTGEKPYKCPECGKSFSRSDKLTEHQRTHTGEKPYKCPECGKSFSRSDNLVRHQRTHTGEKPYKCPECGKSFSRADNLTEHQRTHTGEKPYKCPECGKSFSRSDNLVRHQRTHTGEKPYKCPECGKSFSRSDHLTNHQRTHTGEKPTGKKTS

SEQ ID NO: 1488 - protein, 209 aa, Artificial Sequence
  source: /note="Description of Artificial Sequence: Synthetic polypeptide"
LEPGEKPYKCPECGKSFSQRAHLERHQRTHTGEKPYKCPECGKSFSRSDKLTEHQRTHTGEKPYKCPECGKSFSRSDNLVRHQRTHTGEKPYKCPECGKSFSRADNLTEHQRTHTGEKPYKCPECGKSFSRSDNLVRHQRTHTGEKPYKCPECGKSFSRSDHLTNHQRTHTGEKPYKCPECGKSFSSKKALTEHQRTHTGEKPTGKKTS

SEQ ID NO: 1489 - protein, 209 aa, Artificial Sequence
  source: /note="Description of Artificial Sequence: Synthetic polypeptide"
LEPGEKPYKCPECGKSFSQRAHLERHQRTHTGEKPYKCPECGKSFSHKNALQNHQRTHTGEKPYKCPECGKSFSQRAHLERHQRTHTGEKPYKCPECGKSFSRSDKLTEHQRTHTGEKPYKCPECGKSFSRSDNLVRHQRTHTGEKPYKCPECGKSFSRADNLTEHQRTHTGEKPYKCPECGKSFSRSDNLVRHQRTHTGEKPTGKKTS

SEQ ID NO: 1490 - protein, 209 aa, Artificial Sequence
  source: /note="Description of Artificial Sequence: Synthetic polypeptide"
LEPGEKPYKCPECGKSFSTSGHLVRHQRTHTGEKPYKCPECGKSFSQRAHLERHQRTHTGEKPYKCPECGKSFSHKNALQNHQRTHTGEKPYKCPECGKSFSQRAHLERHQRTHTGEKPYKCPECGKSFSRSDKLTEHQRTHTGEKPYKCPECGKSFSRSDNLVRHQRTHTGEKPYKCPECGKSFSRADNLTEHQRTHTGEKPTGKKTS

SEQ ID NO: 1491 - protein, 209 aa, Artificial Sequence
  source: /note="Description of Artificial Sequence: Synthetic polypeptide"
LEPGEKPYKCPECGKSFSQSSNLVRHQRTHTGEKPYKCPECGKSFSTSGHLVRHQRTHTGEKPYKCPECGKSFSQRAHLERHQRTHTGEKPYKCPECGKSFSHKNALQNHQRTHTGEKPYKCPECGKSFSQRAHLERHQRTHTGEKPYKCPECGKSFSRSDKLTEHQRTHTGEKPYKCPECGKSFSRSDNLVRHQRTHTGEKPTGKKTS

SEQ ID NO: 1492 - protein, 209 aa, Artificial Sequence
  source: /note="Description of Artificial Sequence: Synthetic polypeptide"
LEPGEKPYKCPECGKSFSQSSNLVRHQRTHTGEKPYKCPECGKSFSRSDKLVRHQRTHTGEKPYKCPECGKSFSERSHLREHQRTHTGEKPYKCPECGKSFSRSDHLTNHQRTHTGEKPYKCPECGKSFSERSHLREHQRTHTGEKPYKCPECGKSFSRSDKLVRHQRTHTGEKPYKCPECGKSFSSPADLTRHQRTHTGEKPTGKKTS

SEQ ID NO: 1493 - protein, 209 aa, Artificial Sequence
  source: /note="Description of Artificial Sequence: Synthetic polypeptide"
LEPGEKPYKCPECGKSFSRSDHLTNHQRTHTGEKPYKCPECGKSFSRSDHLTTHQRTHTGEKPYKCPECGKSFSTTGNLTVHQRTHTGEKPYKCPECGKSFSRSDKLVRHQRTHTGEKPYKCPECGKSFSRSDDLVRHQRTHTGEKPYKCPECGKSFSQRAHLERHQRTHTGEKPYKCPECGKSFSQSGDLRRHQRTHTGEKPTGKKTS

SEQ ID NO: 1494 - protein, 209 aa, Artificial Sequence
  source: /note="Description of Artificial Sequence: Synthetic polypeptide"
LEPGEKPYKCPECGKSFSQAGHLASHQRTHTGEKPYKCPECGKSFSRSDHLTNHQRTHTGEKPYKCPECGKSFSRSDHLTTHQRTHTGEKPYKCPECGKSFSTTGNLTVHQRTHTGEKPYKCPECGKSFSRSDKLVRHQRTHTGEKPYKCPECGKSFSRSDDLVRHQRTHTGEKPYKCPECGKSFSQRAHLERHQRTHTGEKPTGKKTS

SEQ ID NO: 1495 - protein, 209 aa, Artificial Sequence
  source: /note="Description of Artificial Sequence: Synthetic polypeptide"
LEPGEKPYKCPECGKSFSTTGNLTVHQRTHTGEKPYKCPECGKSFSRSDKLVRHQRTHTGEKPYKCPECGKSFSRSDDLVRHQRTHTGEKPYKCPECGKSFSQRAHLERHQRTHTGEKPYKCPECGKSFSQSGDLRRHQRTHTGEKPYKCPECGKSFSQRAHLERHQRTHTGEKPYKCPECGKSFSRADNLTEHQRTHTGEKPTGKKTS

SEQ ID NO: 1496 - protein, 209 aa, Artificial Sequence
  source: /note="Description of Artificial Sequence: Synthetic polypeptide"
LEPGEKPYKCPECGKSFSRSDHLTTHQRTHTGEKPYKCPECGKSFSTTGNLTVHQRTHTGEKPYKCPECGKSFSRSDKLVRHQRTHTGEKPYKCPECGKSFSRSDDLVRHQRTHTGEKPYKCPECGKSFSQRAHLERHQRTHTGEKPYKCPECGKSFSQSGDLRRHQRTHTGEKPYKCPECGKSFSQRAHLERHQRTHTGEKPTGKKTS

SEQ ID NO: 1497 - protein, 209 aa, Artificial Sequence
  source: /note="Description of Artificial Sequence: Synthetic polypeptide"
LEPGEKPYKCPECGKSFSDPGALVRHQRTHTGEKPYKCPECGKSFSTSHSLTEHQRTHTGEKPYKCPECGKSFSTTGALTEHQRTHTGEKPYKCPECGKSFSQRANLRAHQRTHTGEKPYKCPECGKSFSSKKHLAEHQRTHTGEKPYKCPECGKSFSTKNSLTEHQRTHTGEKPYKCPECGKSFSDPGHLVRHQRTHTGEKPTGKKTS

SEQ ID NO: 1498 - protein, 209 aa, Artificial Sequence
  source: /note="Description of Artificial Sequence: Synthetic polypeptide"
LEPGEKPYKCPECGKSFSTSGNLTEHQRTHTGEKPYKCPECGKSFSDPGALVRHQRTHTGEKPYKCPECGKSFSTSHSLTEHQRTHTGEKPYKCPECGKSFSTTGALTEHQRTHTGEKPYKCPECGKSFSQRANLRAHQRTHTGEKPYKCPECGKSFSSKKHLAEHQRTHTGEKPYKCPECGKSFSTKNSLTEHQRTHTGEKPTGKKTS

SEQ ID NO: 1499 - protein, 209 aa, Artificial Sequence
  source: /note="Description of Artificial Sequence: Synthetic polypeptide"
LEPGEKPYKCPECGKSFSRSDHLTTHQRTHTGEKPYKCPECGKSFSDSGNLRVHQRTHTGEKPYKCPECGKSFSRSDKLVRHQRTHTGEKPYKCPECGKSFSRSDKLTEHQRTHTGEKPYKCPECGKSFSRNDALTEHQRTHTGEKPYKCPECGKSFSQRANLRAHQRTHTGEKPYKCPECGKSFSRSDKLVRHQRTHTGEKPTGKKTS

SEQ ID NO: 1500 - protein, 209 aa, Artificial Sequence
  source: /note="Description of Artificial Sequence: Synthetic polypeptide"
LEPGEKPYKCPECGKSFSDSGNLRVHQRTHTGEKPYKCPECGKSFSRSDKLVRHQRTHTGEKPYKCPECGKSFSRSDKLTEHQRTHTGEKPYKCPECGKSFSRNDALTEHQRTHTGEKPYKCPECGKSFSQRANLRAHQRTHTGEKPYKCPECGKSFSRSDKLVRHQRTHTGEKPYKCPECGKSFSDKKDLTRHQRTHTGEKPTGKKTS

SEQ ID NO: 1501 - protein, 209 aa, Artificial Sequence
  source: /note="Description of Artificial Sequence: Synthetic polypeptide"
LEPGEKPYKCPECGKSFSRKDNLKNHQRTHTGEKPYKCPECGKSFSRSDHLTTHQRTHTGEKPYKCPECGKSFSDSGNLRVHQRTHTGEKPYKCPECGKSFSRSDKLVRHQRTHTGEKPYKCPECGKSFSRSDKLTEHQRTHTGEKPYKCPECGKSFSRNDALTEHQRTHTGEKPYKCPECGKSFSQRANLRAHQRTHTGEKPTGKKTS

SEQ ID NO: 1502 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSRSDKLTEHQRTHTGEKPYKCPECGKSFSRNDALTEHQRTHTGEKPYKCPECGKSFSQRANLRAHQRTHTGEKPYKCPECGKSFSRSDKLVRHQRTHTGEKPYKCPECGKSFSDKKDLTRHQRTHTGEKPYKCPECGKSFSQRAHLERHQRTHTGEKPTGKKTS

SEQ ID NO: 1503 - protein, 209 aa, Artificial Sequence
  source: /note="Description of Artificial Sequence: Synthetic polypeptide"
LEPGEKPYKCPECGKSFSRSDKLTEHQRTHTGEKPYKCPECGKSFSRNDALTEHQRTHTGEKPYKCPECGKSFSQRANLRAHQRTHTGEKPYKCPECGKSFSRSDKLVRHQRTHTGEKPYKCPECGKSFSDKKDLTRHQRTHTGEKPYKCPECGKSFSQRAHLERHQRTHTGEKPYKCPECGKSFSRSDHLTNHQRTHTGEKPTGKKTS

SEQ ID NO: 1504 - protein, 209 aa, Artificial Sequence
  source: /note="Description of Artificial Sequence: Synthetic polypeptide"
LEPGEKPYKCPECGKSFSQRAHLERHQRTHTGEKPYKCPECGKSFSRKDNLKNHQRTHTGEKPYKCPECGKSFSRSDHLTTHQRTHTGEKPYKCPECGKSFSDSGNLRVHQRTHTGEKPYKCPECGKSFSRSDKLVRHQRTHTGEKPYKCPECGKSFSRSDKLTEHQRTHTGEKPYKCPECGKSFSRNDALTEHQRTHTGEKPTGKKTS

SEQ ID NO: 1505 - protein, 209 aa, Artificial Sequence
  source: /note="Description of Artificial Sequence: Synthetic polypeptide"
LEPGEKPYKCPECGKSFSTSGELVRHQRTHTGEKPYKCPECGKSFSQRAHLERHQRTHTGEKPYKCPECGKSFSRKDNLKNHQRTHTGEKPYKCPECGKSFSRSDHLTTHQRTHTGEKPYKCPECGKSFSDSGNLRVHQRTHTGEKPYKCPECGKSFSRSDKLVRHQRTHTGEKPYKCPECGKSFSRSDKLTEHQRTHTGEKPTGKKTS

SEQ ID NO: 1506 - protein, 209 aa, Artificial Sequence
  source: /note="Description of Artificial Sequence: Synthetic polypeptide"
LEPGEKPYKCPECGKSFSRNDALTEHQRTHTGEKPYKCPECGKSFSQRANLRAHQRTHTGEKPYKCPECGKSFSRSDKLVRHQRTHTGEKPYKCPECGKSFSDKKDLTRHQRTHTGEKPYKCPECGKSFSQRAHLERHQRTHTGEKPYKCPECGKSFSRSDHLTNHQRTHTGEKPYKCPECGKSFSSKKHLAEHQRTHTGEKPTGKKTS

SEQ ID NO: 1507 - protein, 209 aa, Artificial Sequence
  source: /note="Description of Artificial Sequence: Synthetic polypeptide"
LEPGEKPYKCPECGKSFSQRANLRAHQRTHTGEKPYKCPECGKSFSRSDKLVRHQRTHTGEKPYKCPECGKSFSDKKDLTRHQRTHTGEKPYKCPECGKSFSQRAHLERHQRTHTGEKPYKCPECGKSFSRSDHLTNHQRTHTGEKPYKCPECGKSFSSKKHLAEHQRTHTGEKPYKCPECGKSFSTSGELVRHQRTHTGEKPTGKKTS

SEQ ID NO: 1508 - protein, 209 aa, Artificial Sequence
  source: /note="Description of Artificial Sequence: Synthetic polypeptide"
LEPGEKPYKCPECGKSFSSKKHLAEHQRTHTGEKPYKCPECGKSFSTSGELVRHQRTHTGEKPYKCPECGKSFSQRAHLERHQRTHTGEKPYKCPECGKSFSRKDNLKNHQRTHTGEKPYKCPECGKSFSRSDHLTTHQRTHTGEKPYKCPECGKSFSDSGNLRVHQRTHTGEKPYKCPECGKSFSRSDKLVRHQRTHTGEKPTGKKTS

SEQ ID NO: 1509 - protein, 209 aa, Artificial Sequence
  source: /note="Description of Artificial Sequence: Synthetic polypeptide"
LEPGEKPYKCPECGKSFSQLAHLRAHQRTHTGEKPYKCPECGKSFSSKKHLAEHQRTHTGEKPYKCPECGKSFSTSGELVRHQRTHTGEKPYKCPECGKSFSQRAHLERHQRTHTGEKPYKCPECGKSFSRKDNLKNHQRTHTGEKPYKCPECGKSFSRSDHLTTHQRTHTGEKPYKCPECGKSFSDSGNLRVHQRTHTGEKPTGKKTS

SEQ ID NO: 1510 - protein, 209 aa, Artificial Sequence
  source: /note="Description of Artificial Sequence: Synthetic polypeptide"
LEPGEKPYKCPECGKSFSSPADLTRHQRTHTGEKPYKCPECGKSFSQLAHLRAHQRTHTGEKPYKCPECGKSFSSKKHLAEHQRTHTGEKPYKCPECGKSFSTSGELVRHQRTHTGEKPYKCPECGKSFSQRAHLERHQRTHTGEKPYKCPECGKSFSRKDNLKNHQRTHTGEKPYKCPECGKSFSRSDHLTTHQRTHTGEKPTGKKTS

SEQ ID NO: 1511 - protein, 209 aa, Artificial Sequence
  source: /note="Description of Artificial Sequence: Synthetic polypeptide"
LEPGEKPYKCPECGKSFSRSDHLTNHQRTHTGEKPYKCPECGKSFSSPADLTRHQRTHTGEKPYKCPECGKSFSQLAHLRAHQRTHTGEKPYKCPECGKSFSSKKHLAEHQRTHTGEKPYKCPECGKSFSTSGELVRHQRTHTGEKPYKCPECGKSFSQRAHLERHQRTHTGEKPYKCPECGKSFSRKDNLKNHQRTHTGEKPTGKKTS

SEQ ID NO: 1512 - protein, 209 aa, Artificial Sequence
  source: /note="Description of Artificial Sequence: Synthetic polypeptide"
LEPGEKPYKCPECGKSFSRSDDLVRHQRTHTGEKPYKCPECGKSFSTHLDLIRHQRTHTGEKPYKCPECGKSFSQSSNLVRHQRTHTGEKPYKCPECGKSFSRSDKLTEHQRTHTGEKPYKCPECGKSFSDSGNLRVHQRTHTGEKPYKCPECGKSFSRSDKLVRHQRTHTGEKPYKCPECGKSFSRADNLTEHQRTHTGEKPTGKKTS

SEQ ID NO: 1513 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSRSDDLVRHQRTHTGEKPYKCPECGKSFSTHLDLIRHQRTHTGEKPYKCPECGKSFSQSSNLVRHQRTHTGEKPYKCPECGKSFSRSDKLTEHQRTHTGEKPYKCPECGKSFSDSGNLRVHQRTHTGEKPYKCPECGKSFSRSDKLVRHQRTHTGEKPTGKKTS

SEQ ID NO: 1514 - protein, 209 aa, Artificial Sequence
  source: /note="Description of Artificial Sequence: Synthetic polypeptide"
LEPGEKPYKCPECGKSFSQSSNLVRHQRTHTGEKPYKCPECGKSFSRSDKLVRHQRTHTGEKPYKCPECGKSFSRSDDLVRHQRTHTGEKPYKCPECGKSFSTHLDLIRHQRTHTGEKPYKCPECGKSFSQSSNLVRHQRTHTGEKPYKCPECGKSFSRSDKLTEHQRTHTGEKPYKCPECGKSFSDSGNLRVHQRTHTGEKPTGKKTS

SEQ ID NO: 1515 - protein, 209 aa, Artificial Sequence
  source: /note="Description of Artificial Sequence: Synthetic polypeptide"
LEPGEKPYKCPECGKSFSERSHLREHQRTHTGEKPYKCPECGKSFSRSDKLVRHQRTHTGEKPYKCPECGKSFSQSSNLVRHQRTHTGEKPYKCPECGKSFSRNDALTEHQRTHTGEKPYKCPECGKSFSQSSNLVRHQRTHTGEKPYKCPECGKSFSRSDKLVRHQRTHTGEKPYKCPECGKSFSRSDDLVRHQRTHTGEKPTGKKTS

SEQ ID NO: 1516 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSQSSNLVRHQRTHTGEKPYKCPECGKSFSRNDALTEHQRTHTGEKPYKCPECGKSFSQSSNLVRHQRTHTGEKPYKCPECGKSFSRSDKLVRHQRTHTGEKPYKCPECGKSFSRSDDLVRHQRTHTGEKPYKCPECGKSFSTHLDLIRHQRTHTGEKPTGKKTS

SEQ ID NO: 1517 - protein, 209 aa, Artificial Sequence
  source: /note="Description of Artificial Sequence: Synthetic polypeptide"
LEPGEKPYKCPECGKSFSRNDALTEHQRTHTGEKPYKCPECGKSFSQSSNLVRHQRTHTGEKPYKCPECGKSFSRSDKLVRHQRTHTGEKPYKCPECGKSFSRSDDLVRHQRTHTGEKPYKCPECGKSFSTHLDLIRHQRTHTGEKPYKCPECGKSFSQSSNLVRHQRTHTGEKPYKCPECGKSFSRSDKLTEHQRTHTGEKPTGKKTS

SEQ ID NO: 1518 - protein, 209 aa, Artificial Sequence
  source: /note="Description of Artificial Sequence: Synthetic polypeptide"
LEPGEKPYKCPECGKSFSQSSNLVRHQRTHTGEKPYKCPECGKSFSRNDALTEHQRTHTGEKPYKCPECGKSFSQSSNLVRHQRTHTGEKPYKCPECGKSFSRSDKLVRHQRTHTGEKPYKCPECGKSFSRSDDLVRHQRTHTGEKPYKCPECGKSFSTHLDLIRHQRTHTGEKPYKCPECGKSFSQSSNLVRHQRTHTGEKPTGKKTS

SEQ ID NO: 1519 - protein, 209 aa, Artificial Sequence
  source: /note="Description of Artificial Sequence: Synthetic polypeptide"
LEPGEKPYKCPECGKSFSREDNLHTHQRTHTGEKPYKCPECGKSFSHKNALQNHQRTHTGEKPYKCPECGKSFSRSDKLVRHQRTHTGEKPYKCPECGKSFSTKNSLTEHQRTHTGEKPYKCPECGKSFSRSDKLVRHQRTHTGEKPYKCPECGKSFSRNDALTEHQRTHTGEKPYKCPECGKSFSTSGNLTEHQRTHTGEKPTGKKTS

SEQ ID NO: 1520 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSTKNSLTEHQRTHTGEKPYKCPECGKSFSRSDKLVRHQRTHTGEKPYKCPECGKSFSRNDALTEHQRTHTGEKPYKCPECGKSFSTSGNLTEHQRTHTGEKPYKCPECGKSFSRSDHLTTHQRTHTGEKPYKCPECGKSFSTSGNLVRHQRTHTGEKPTGKKTS

SEQ ID NO: 1521 - protein, 209 aa, Artificial Sequence
  source: /note="Description of Artificial Sequence: Synthetic polypeptide"
LEPGEKPYKCPECGKSFSHKNALQNHQRTHTGEKPYKCPECGKSFSRSDKLVRHQRTHTGEKPYKCPECGKSFSTKNSLTEHQRTHTGEKPYKCPECGKSFSRSDKLVRHQRTHTGEKPYKCPECGKSFSRNDALTEHQRTHTGEKPYKCPECGKSFSTSGNLTEHQRTHTGEKPYKCPECGKSFSRSDHLTTHQRTHTGEKPTGKKTS

SEQ ID NO: 1522 - protein, 209 aa, Artificial Sequence
  source: /note="Description of Artificial Sequence: Synthetic polypeptide"
LEPGEKPYKCPECGKSFSTSGNLVRHQRTHTGEKPYKCPECGKSFSQSSNLVRHQRTHTGEKPYKCPECGKSFSTSHSLTEHQRTHTGEKPYKCPECGKSFSTSGNLVRHQRTHTGEKPYKCPECGKSFSRKDNLKNHQRTHTGEKPYKCPECGKSFSDSGNLRVHQRTHTGEKPYKCPECGKSFSRADNLTEHQRTHTGEKPTGKKTS

SEQ ID NO: 1523 - protein, 209 aa, Artificial Sequence
  source: /note="Description of Artificial Sequence: Synthetic polypeptide"
LEPGEKPYKCPECGKSFSTKNSLTEHQRTHTGEKPYKCPECGKSFSRSDKLVRHQRTHTGEKPYKCPECGKSFSRNDALTEHQRTHTGEKPYKCPECGKSFSTSGNLTEHQRTHTGEKPYKCPECGKSFSRSDHLTTHQRTHTGEKPYKCPECGKSFSTSGNLVRHQRTHTGEKPYKCPECGKSFSQSSNLVRHQRTHTGEKPTGKKTS

SEQ ID NO: 1524 - protein, 209 aa, Artificial Sequence
  source: /note="Description of Artificial Sequence: Synthetic polypeptide"
LEPGEKPYKCPECGKSFSRSDHLTTHQRTHTGEKPYKCPECGKSFSTSGNLVRHQRTHTGEKPYKCPECGKSFSQSSNLVRHQRTHTGEKPYKCPECGKSFSTSHSLTEHQRTHTGEKPYKCPECGKSFSTSGNLVRHQRTHTGEKPYKCPECGKSFSRKDNLKNHQRTHTGEKPYKCPECGKSFSDSGNLRVHQRTHTGEKPTGKKTS

SEQ ID NO: 1525 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSRNDALTEHQRTHTGEKPYKCPECGKSFSTSGNLTEHQRTHTGEKPYKCPECGKSFSRSDHLTTHQRTHTGEKPYKCPECGKSFSTSGNLVRHQRTHTGEKPYKCPECGKSFSQSSNLVRHQRTHTGEKPYKCPECGKSFSTSHSLTEHQRTHTGEKPTGKKTS

SEQ ID NO: 1526 - protein, 209 aa, Artificial Sequence
  source: /note="Description of Artificial Sequence: Synthetic polypeptide"
LEPGEKPYKCPECGKSFSRNDALTEHQRTHTGEKPYKCPECGKSFSTSGNLTEHQRTHTGEKPYKCPECGKSFSRSDHLTTHQRTHTGEKPYKCPECGKSFSTSGNLVRHQRTHTGEKPYKCPECGKSFSQSSNLVRHQRTHTGEKPYKCPECGKSFSTSHSLTEHQRTHTGEKPYKCPECGKSFSTSGNLVRHQRTHTGEKPTGKKTS

SEQ ID NO: 1527 - protein, 209 aa, Artificial Sequence
  source: /note="Description of Artificial Sequence: Synthetic polypeptide"
LEPGEKPYKCPECGKSFSTSGNLTEHQRTHTGEKPYKCPECGKSFSRSDHLTTHQRTHTGEKPYKCPECGKSFSTSGNLVRHQRTHTGEKPYKCPECGKSFSQSSNLVRHQRTHTGEKPYKCPECGKSFSTSHSLTEHQRTHTGEKPYKCPECGKSFSTSGNLVRHQRTHTGEKPYKCPECGKSFSRKDNLKNHQRTHTGEKPTGKKTS

SEQ ID NO: 1528 - protein, 209 aa, Artificial Sequence
  source: /note="Description of Artificial Sequence: Synthetic polypeptide"
LEPGEKPYKCPECGKSFSTSGSLVRHQRTHTGEKPYKCPECGKSFSREDNLHTHQRTHTGEKPYKCPECGKSFSHKNALQNHQRTHTGEKPYKCPECGKSFSRSDKLVRHQRTHTGEKPYKCPECGKSFSTKNSLTEHQRTHTGEKPYKCPECGKSFSRSDKLVRHQRTHTGEKPYKCPECGKSFSRNDALTEHQRTHTGEKPTGKKTS

SEQ ID NO: 1529 - protein, 209 aa, Artificial Sequence
  source: /note="Description of Artificial Sequence: Synthetic polypeptide"
LEPGEKPYKCPECGKSFSDPGHLVRHQRTHTGEKPYKCPECGKSFSRSDHLTTHQRTHTGEKPYKCPECGKSFSTSHSLTEHQRTHTGEKPYKCPECGKSFSRSDKLVRHQRTHTGEKPYKCPECGKSFSSRRTCRAHQRTHTGEKPYKCPECGKSFSTTGNLTVHQRTHTGEKPYKCPECGKSFSQNSTLTEHQRTHTGEKPTGKKTS

SEQ ID NO: 1530 - protein, 209 aa, Artificial Sequence
  source: /note="Description of Artificial Sequence: Synthetic polypeptide"
LEPGEKPYKCPECGKSFSERSHLREHQRTHTGEKPYKCPECGKSFSDPGHLVRHQRTHTGEKPYKCPECGKSFSRSDHLTTHQRTHTGEKPYKCPECGKSFSTSHSLTEHQRTHTGEKPYKCPECGKSFSRSDKLVRHQRTHTGEKPYKCPECGKSFSSRRTCRAHQRTHTGEKPYKCPECGKSFSTTGNLTVHQRTHTGEKPTGKKTS

SEQ ID NO: 1531 - protein, 209 aa, Artificial Sequence
  source: /note="Description of Artificial Sequence: Synthetic polypeptide"
LEPGEKPYKCPECGKSFSTTGALTEHQRTHTGEKPYKCPECGKSFSERSHLREHQRTHTGEKPYKCPECGKSFSDPGHLVRHQRTHTGEKPYKCPECGKSFSRSDHLTTHQRTHTGEKPYKCPECGKSFSTSHSLTEHQRTHTGEKPYKCPECGKSFSRSDKLVRHQRTHTGEKPYKCPECGKSFSSRRTCRAHQRTHTGEKPTGKKTS

SEQ ID NO: 1532 - protein, 209 aa, Artificial Sequence
  source: /note="Description of Artificial Sequence: Synthetic polypeptide"
LEPGEKPYKCPECGKSFSREDNLHTHQRTHTGEKPYKCPECGKSFSRSDKLVRHQRTHTGEKPYKCPECGKSFSQAGHLASHQRTHTGEKPYKCPECGKSFSTSGNLTEHQRTHTGEKPYKCPECGKSFSRKDNLKNHQRTHTGEKPYKCPECGKSFSQSGNLTEHQRTHTGEKPYKCPECGKSFSRNDALTEHQRTHTGEKPTGKKTS

SEQ ID NO: 1533 - protein, 209 aa, Artificial Sequence
  source: /note="Description of Artificial Sequence: Synthetic polypeptide"
LEPGEKPYKCPECGKSFSRKDNLKNHQRTHTGEKPYKCPECGKSFSREDNLHTHQRTHTGEKPYKCPECGKSFSRSDKLVRHQRTHTGEKPYKCPECGKSFSQAGHLASHQRTHTGEKPYKCPECGKSFSTSGNLTEHQRTHTGEKPYKCPECGKSFSRKDNLKNHQRTHTGEKPYKCPECGKSFSQSGNLTEHQRTHTGEKPTGKKTS

SEQ ID NO: 1534 - protein, 209 aa, Artificial Sequence
  source: /note="Description of Artificial Sequence: Synthetic polypeptide"
LEPGEKPYKCPECGKSFSHRTTLTNHQRTHTGEKPYKCPECGKSFSQLAHLRAHQRTHTGEKPYKCPECGKSFSTSGHLVRHQRTHTGEKPYKCPECGKSFSRSDNLVRHQRTHTGEKPYKCPECGKSFSHKNALQNHQRTHTGEKPYKCPECGKSFSERSHLREHQRTHTGEKPYKCPECGKSFSQRANLRAHQRTHTGEKPTGKKTS

SEQ ID NO: 1535 - protein, 209 aa, Artificial Sequence
  source: /note="Description of Artificial Sequence: Synthetic polypeptide"
LEPGEKPYKCPECGKSFSQAGHLASHQRTHTGEKPYKCPECGKSFSQSGNLTEHQRTHTGEKPYKCPECGKSFSHRTTLTNHQRTHTGEKPYKCPECGKSFSQLAHLRAHQRTHTGEKPYKCPECGKSFSTSGHLVRHQRTHTGEKPYKCPECGKSFSRSDNLVRHQRTHTGEKPYKCPECGKSFSHKNALQNHQRTHTGEKPTGKKTS

SEQ ID NO: 1536 - protein, 209 aa, Artificial Sequence
  source: /note="Description of Artificial Sequence: Synthetic polypeptide"
LEPGEKPYKCPECGKSFSQSGNLTEHQRTHTGEKPYKCPECGKSFSHRTTLTNHQRTHTGEKPYKCPECGKSFSQLAHLRAHQRTHTGEKPYKCPECGKSFSTSGHLVRHQRTHTGEKPYKCPECGKSFSRSDNLVRHQRTHTGEKPYKCPECGKSFSHKNALQNHQRTHTGEKPYKCPECGKSFSERSHLREHQRTHTGEKPTGKKTS

SEQ ID NO: 1537 - protein, 209 aa, Artificial Sequence
  source: /note="Description of Artificial Sequence: Synthetic polypeptide"
LEPGEKPYKCPECGKSFSQSSNLVRHQRTHTGEKPYKCPECGKSFSHKNALQNHQRTHTGEKPYKCPECGKSFSTSGSLVRHQRTHTGEKPYKCPECGKSFSQSSNLVRHQRTHTGEKPYKCPECGKSFSRSDHLTTHQRTHTGEKPYKCPECGKSFSHKNALQNHQRTHTGEKPYKCPECGKSFSRRDELNVHQRTHTGEKPTGKKTS

SEQ ID NO: 1538 - protein, 209 aa, Artificial Sequence
  source: /note="Description of Artificial Sequence: Synthetic polypeptide"
LEPGEKPYKCPECGKSFSREDNLHTHQRTHTGEKPYKCPECGKSFSQAGHLASHQRTHTGEKPYKCPECGKSFSDCRDLARHQRTHTGEKPYKCPECGKSFSHRTTLTNHQRTHTGEKPYKCPECGKSFSDPGALVRHQRTHTGEKPYKCPECGKSFSTSGELVRHQRTHTGEKPYKCPECGKSFSREDNLHTHQRTHTGEKPTGKKTS

SEQ ID NO: 1539 - protein, 209 aa, Artificial Sequence
  source: /note="Description of Artificial Sequence: Synthetic polypeptide"
LEPGEKPYKCPECGKSFSQAGHLASHQRTHTGEKPYKCPECGKSFSDCRDLARHQRTHTGEKPYKCPECGKSFSHRTTLTNHQRTHTGEKPYKCPECGKSFSDPGALVRHQRTHTGEKPYKCPECGKSFSTSGELVRHQRTHTGEKPYKCPECGKSFSREDNLHTHQRTHTGEKPYKCPECGKSFSRSDHLTNHQRTHTGEKPTGKKTS

SEQ ID NO: 1540 - protein, 209 aa, Artificial Sequence
  source: /note="Description of Artificial Sequence: Synthetic polypeptide"
LEPGEKPYKCPECGKSFSDCRDLARHQRTHTGEKPYKCPECGKSFSHRTTLTNHQRTHTGEKPYKCPECGKSFSDPGALVRHQRTHTGEKPYKCPECGKSFSTSGELVRHQRTHTGEKPYKCPECGKSFSREDNLHTHQRTHTGEKPYKCPECGKSFSRSDHLTNHQRTHTGEKPYKCPECGKSFSRSDKLTEHQRTHTGEKPTGKKTS

SEQ ID NO: 1541 - protein, 209 aa, Artificial Sequence
  source: /note="Description of Artificial Sequence: Synthetic polypeptide"
LEPGEKPYKCPECGKSFSRSDELVRHQRTHTGEKPYKCPECGKSFSRSDKLVRHQRTHTGEKPYKCPECGKSFSTTGALTEHQRTHTGEKPYKCPECGKSFSQAGHLASHQRTHTGEKPYKCPECGKSFSDCRDLARHQRTHTGEKPYKCPECGKSFSTTGNLTVHQRTHTGEKPYKCPECGKSFSREDNLHTHQRTHTGEKPTGKKTS

SEQ ID NO: 1542 - protein, 209 aa, Artificial Sequence
  source: /note="Description of Artificial Sequence: Synthetic polypeptide"
LEPGEKPYKCPECGKSFSSPADLTRHQRTHTGEKPYKCPECGKSFSRSDELVRHQRTHTGEKPYKCPECGKSFSRSDKLVRHQRTHTGEKPYKCPECGKSFSTTGALTEHQRTHTGEKPYKCPECGKSFSQAGHLASHQRTHTGEKPYKCPECGKSFSDCRDLARHQRTHTGEKPYKCPECGKSFSTTGNLTVHQRTHTGEKPTGKKTS

SEQ ID NO: 1543 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSTTGALTEHQRTHTGEKPYKCPECGKSFSQAGHLASHQRTHTGEKPYKCPECGKSFSDCRDLARHQRTHTGEKPYKCPECGKSFSTTGNLTVHQRTHTGEKPYKCPECGKSFSREDNLHTHQRTHTGEKPYKCPECGKSFSHRTTLTNHQRTHTGEKPTGKKTS

SEQ ID NO: 1544 - protein, 209 aa, Artificial Sequence
  source: /note="Description of Artificial Sequence: Synthetic polypeptide"
LEPGEKPYKCPECGKSFSRRDELNVHQRTHTGEKPYKCPECGKSFSSPADLTRHQRTHTGEKPYKCPECGKSFSRSDELVRHQRTHTGEKPYKCPECGKSFSRSDKLVRHQRTHTGEKPYKCPECGKSFSTTGALTEHQRTHTGEKPYKCPECGKSFSQAGHLASHQRTHTGEKPYKCPECGKSFSDCRDLARHQRTHTGEKPTGKKTS

SEQ ID NO: 1545 - protein, 209 aa, Artificial Sequence
  source: /note="Description of Artificial Sequence: Synthetic polypeptide"
LEPGEKPYKCPECGKSFSRSDHLTNHQRTHTGEKPYKCPECGKSFSRSDHLTTHQRTHTGEKPYKCPECGKSFSTSGELVRHQRTHTGEKPYKCPECGKSFSRRDELNVHQRTHTGEKPYKCPECGKSFSSPADLTRHQRTHTGEKPYKCPECGKSFSRSDELVRHQRTHTGEKPYKCPECGKSFSRSDKLVRHQRTHTGEKPTGKKTS

SEQ ID NO: 1546 - protein, 209 aa, Artificial Sequence
  source: /note="Description of Artificial Sequence: Synthetic polypeptide"
LEPGEKPYKCPECGKSFSTSGELVRHQRTHTGEKPYKCPECGKSFSRRDELNVHQRTHTGEKPYKCPECGKSFSSPADLTRHQRTHTGEKPYKCPECGKSFSRSDELVRHQRTHTGEKPYKCPECGKSFSRSDKLVRHQRTHTGEKPYKCPECGKSFSTTGALTEHQRTHTGEKPYKCPECGKSFSQAGHLASHQRTHTGEKPTGKKTS

SEQ ID NO: 1547 - protein, 209 aa, Artificial Sequence
  source: /note="Description of Artificial Sequence: Synthetic polypeptide"
LEPGEKPYKCPECGKSFSDPGALVRHQRTHTGEKPYKCPECGKSFSQAGHLASHQRTHTGEKPYKCPECGKSFSRSDKLVRHQRTHTGEKPYKCPECGKSFSTSGHLVRHQRTHTGEKPYKCPECGKSFSRSDHLTNHQRTHTGEKPYKCPECGKSFSRSDHLTTHQRTHTGEKPYKCPECGKSFSTSGELVRHQRTHTGEKPTGKKTS

SEQ ID NO: 1548 - protein, 209 aa, Artificial Sequence
  source: /note="Description of Artificial Sequence: Synthetic polypeptide"
LEPGEKPYKCPECGKSFSRKDNLKNHQRTHTGEKPYKCPECGKSFSDPGALVRHQRTHTGEKPYKCPECGKSFSQAGHLASHQRTHTGEKPYKCPECGKSFSRSDKLVRHQRTHTGEKPYKCPECGKSFSTSGHLVRHQRTHTGEKPYKCPECGKSFSRSDHLTNHQRTHTGEKPYKCPECGKSFSRSDHLTTHQRTHTGEKPTGKKTS

SEQ ID NO: 1549 - protein, 209 aa, Artificial Sequence
  source: /note="Description of Artificial Sequence: Synthetic polypeptide"
LEPGEKPYKCPECGKSFSTSGHLVRHQRTHTGEKPYKCPECGKSFSRSDHLTNHQRTHTGEKPYKCPECGKSFSRSDHLTTHQRTHTGEKPYKCPECGKSFSTSGELVRHQRTHTGEKPYKCPECGKSFSRRDELNVHQRTHTGEKPYKCPECGKSFSSPADLTRHQRTHTGEKPYKCPECGKSFSRSDELVRHQRTHTGEKPTGKKTS

SEQ ID NO: 1550 - protein, 209 aa, Artificial Sequence
  source: /note="Description of Artificial Sequence: Synthetic polypeptide"
LEPGEKPYKCPECGKSFSQAGHLASHQRTHTGEKPYKCPECGKSFSRSDKLVRHQRTHTGEKPYKCPECGKSFSTSGHLVRHQRTHTGEKPYKCPECGKSFSRSDHLTNHQRTHTGEKPYKCPECGKSFSRSDHLTTHQRTHTGEKPYKCPECGKSFSTSGELVRHQRTHTGEKPYKCPECGKSFSRRDELNVHQRTHTGEKPTGKKTS

SEQ ID NO: 1551 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSTSGHLVRHQRTHTGEKPYKCPECGKSFSRSDHLTNHQRTHTGEKPYKCPECGKSFSRSDHLTTHQRTHTGEKPYKCPECGKSFSTSGELVRHQRTHTGEKPYKCPECGKSFSRRDELNVHQRTHTGEKPYKCPECGKSFSSPADLTRHQRTHTGEKPTGKKTS

SEQ ID NO: 1552 - protein, 209 aa, Artificial Sequence
  source: /note="Description of Artificial Sequence: Synthetic polypeptide"
LEPGEKPYKCPECGKSFSRRDELNVHQRTHTGEKPYKCPECGKSFSQSGNLTEHQRTHTGEKPYKCPECGKSFSTSGHLVRHQRTHTGEKPYKCPECGKSFSRKDNLKNHQRTHTGEKPYKCPECGKSFSDPGALVRHQRTHTGEKPYKCPECGKSFSQAGHLASHQRTHTGEKPYKCPECGKSFSRSDKLVRHQRTHTGEKPTGKKTS

SEQ ID NO: 1553 - protein, 209 aa, Artificial Sequence
  source: /note="Description of Artificial Sequence: Synthetic polypeptide"
LEPGEKPYKCPECGKSFSRSDNLVRHQRTHTGEKPYKCPECGKSFSSRRTCRAHQRTHTGEKPYKCPECGKSFSDCRDLARHQRTHTGEKPYKCPECGKSFSHRTTLTNHQRTHTGEKPYKCPECGKSFSRRDELNVHQRTHTGEKPYKCPECGKSFSQSGNLTEHQRTHTGEKPYKCPECGKSFSTSGHLVRHQRTHTGEKPTGKKTS

SEQ ID NO: 1554 - protein, 209 aa, Artificial Sequence
  source: /note="Description of Artificial Sequence: Synthetic polypeptide"
LEPGEKPYKCPECGKSFSHRTTLTNHQRTHTGEKPYKCPECGKSFSRRDELNVHQRTHTGEKPYKCPECGKSFSQSGNLTEHQRTHTGEKPYKCPECGKSFSTSGHLVRHQRTHTGEKPYKCPECGKSFSRKDNLKNHQRTHTGEKPYKCPECGKSFSDPGALVRHQRTHTGEKPYKCPECGKSFSQAGHLASHQRTHTGEKPTGKKTS

SEQ ID NO: 1555 - protein, 209 aa, Artificial Sequence
  source: /note="Description of Artificial Sequence: Synthetic polypeptide"
LEPGEKPYKCPECGKSFSDCRDLARHQRTHTGEKPYKCPECGKSFSHRTTLTNHQRTHTGEKPYKCPECGKSFSRRDELNVHQRTHTGEKPYKCPECGKSFSQSGNLTEHQRTHTGEKPYKCPECGKSFSTSGHLVRHQRTHTGEKPYKCPECGKSFSRKDNLKNHQRTHTGEKPYKCPECGKSFSDPGALVRHQRTHTGEKPTGKKTS

SEQ ID NO: 1556 - protein, 209 aa, Artificial Sequence
  source: /note="Description of Artificial Sequence: Synthetic polypeptide"
LEPGEKPYKCPECGKSFSSRRTCRAHQRTHTGEKPYKCPECGKSFSDCRDLARHQRTHTGEKPYKCPECGKSFSHRTTLTNHQRTHTGEKPYKCPECGKSFSRRDELNVHQRTHTGEKPYKCPECGKSFSQSGNLTEHQRTHTGEKPYKCPECGKSFSTSGHLVRHQRTHTGEKPYKCPECGKSFSRKDNLKNHQRTHTGEKPTGKKTS

SEQ ID NO: 1557 - protein, 209 aa, Artificial Sequence
  source: /note="Description of Artificial Sequence: Synthetic polypeptide"
LEPGEKPYKCPECGKSFSTSGHLVRHQRTHTGEKPYKCPECGKSFSRKDNLKNHQRTHTGEKPYKCPECGKSFSDPGALVRHQRTHTGEKPYKCPECGKSFSQAGHLASHQRTHTGEKPYKCPECGKSFSRSDKLVRHQRTHTGEKPYKCPECGKSFSTSGHLVRHQRTHTGEKPYKCPECGKSFSRSDHLTNHQRTHTGEKPTGKKTS

SEQ ID NO: 1558 - protein, 209 aa, Artificial Sequence
  source: /note="Description of Artificial Sequence: Synthetic polypeptide"
LEPGEKPYKCPECGKSFSQSGNLTEHQRTHTGEKPYKCPECGKSFSTSGHLVRHQRTHTGEKPYKCPECGKSFSRKDNLKNHQRTHTGEKPYKCPECGKSFSDPGALVRHQRTHTGEKPYKCPECGKSFSQAGHLASHQRTHTGEKPYKCPECGKSFSRSDKLVRHQRTHTGEKPYKCPECGKSFSTSGHLVRHQRTHTGEKPTGKKTS

SEQ ID NO: 1559 - protein, 209 aa, Artificial Sequence
  source: /note="Description of Artificial Sequence: Synthetic polypeptide"
LEPGEKPYKCPECGKSFSDPGHLVRHQRTHTGEKPYKCPECGKSFSTTGNLTVHQRTHTGEKPYKCPECGKSFSDPGNLVRHQRTHTGEKPYKCPECGKSFSTSGHLVRHQRTHTGEKPYKCPECGKSFSRSDHLTTHQRTHTGEKPYKCPECGKSFSTHLDLIRHQRTHTGEKPYKCPECGKSFSRNDALTEHQRTHTGEKPTGKKTS

SEQ ID NO: 1560 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSQRAHLERHQRTHTGEKPYKCPECGKSFSTTGALTEHQRTHTGEKPYKCPECGKSFSRSDHLTTHQRTHTGEKPYKCPECGKSFSQSGNLTEHQRTHTGEKPYKCPECGKSFSQAGHLASHQRTHTGEKPYKCPECGKSFSRSDKLVRHQRTHTGEKPTGKKTS

SEQ ID NO: 1561 - protein, 209 aa, Artificial Sequence
  source: /note="Description of Artificial Sequence: Synthetic polypeptide"
LEPGEKPYKCPECGKSFSRSDELVRHQRTHTGEKPYKCPECGKSFSRSDKLVRHQRTHTGEKPYKCPECGKSFSQRAHLERHQRTHTGEKPYKCPECGKSFSTTGALTEHQRTHTGEKPYKCPECGKSFSRSDHLTTHQRTHTGEKPYKCPECGKSFSQSGNLTEHQRTHTGEKPYKCPECGKSFSQAGHLASHQRTHTGEKPTGKKTS

SEQ ID NO: 1562 - protein, 209 aa, Artificial Sequence
  source: /note="Description of Artificial Sequence: Synthetic polypeptide"
LEPGEKPYKCPECGKSFSRSDNLVRHQRTHTGEKPYKCPECGKSFSTSGHLVRHQRTHTGEKPYKCPECGKSFSRSDELVRHQRTHTGEKPYKCPECGKSFSRSDKLVRHQRTHTGEKPYKCPECGKSFSQRAHLERHQRTHTGEKPYKCPECGKSFSTTGALTEHQRTHTGEKPYKCPECGKSFSRSDHLTTHQRTHTGEKPTGKKTS

SEQ ID NO: 1563 - protein, 209 aa, Artificial Sequence
  source: /note="Description of Artificial Sequence: Synthetic polypeptide"
LEPGEKPYKCPECGKSFSTSGHLVRHQRTHTGEKPYKCPECGKSFSRSDELVRHQRTHTGEKPYKCPECGKSFSRSDKLVRHQRTHTGEKPYKCPECGKSFSQRAHLERHQRTHTGEKPYKCPECGKSFSTTGALTEHQRTHTGEKPYKCPECGKSFSRSDHLTTHQRTHTGEKPYKCPECGKSFSQSGNLTEHQRTHTGEKPTGKKTS

SEQ ID NO: 1564 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSQSGNLTEHQRTHTGEKPYKCPECGKSFSHRTTLTNHQRTHTGEKPYKCPECGKSFSRSDELVRHQRTHTGEKPYKCPECGKSFSRSDHLTTHQRTHTGEKPYKCPECGKSFSRSDKLVRHQRTHTGEKPYKCPECGKSFSRSDNLVRHQRTHTGEKPTGKKTS

SEQ ID NO: 1565 - protein, 209 aa, Artificial Sequence
  source: /note="Description of Artificial Sequence: Synthetic polypeptide"
LEPGEKPYKCPECGKSFSRSDELVRHQRTHTGEKPYKCPECGKSFSSKKHLAEHQRTHTGEKPYKCPECGKSFSRSDELVRHQRTHTGEKPYKCPECGKSFSQAGHLASHQRTHTGEKPYKCPECGKSFSQRANLRAHQRTHTGEKPYKCPECGKSFSDPGALVRHQRTHTGEKPYKCPECGKSFSRSDHLTNHQRTHTGEKPTGKKTS

SEQ ID NO: 1566 - protein, 209 aa, Artificial Sequence
  source: /note="Description of Artificial Sequence: Synthetic polypeptide"
LEPGEKPYKCPECGKSFSHRTTLTNHQRTHTGEKPYKCPECGKSFSRSDELVRHQRTHTGEKPYKCPECGKSFSSKKHLAEHQRTHTGEKPYKCPECGKSFSRSDELVRHQRTHTGEKPYKCPECGKSFSQAGHLASHQRTHTGEKPYKCPECGKSFSQRANLRAHQRTHTGEKPYKCPECGKSFSDPGALVRHQRTHTGEKPTGKKTS

SEQ ID NO: 1567 - protein, 209 aa, Artificial Sequence
  source: /note="Description of Artificial Sequence: Synthetic polypeptide"
LEPGEKPYKCPECGKSFSTSGNLTEHQRTHTGEKPYKCPECGKSFSHRTTLTNHQRTHTGEKPYKCPECGKSFSRSDELVRHQRTHTGEKPYKCPECGKSFSSKKHLAEHQRTHTGEKPYKCPECGKSFSRSDELVRHQRTHTGEKPYKCPECGKSFSQAGHLASHQRTHTGEKPYKCPECGKSFSQRANLRAHQRTHTGEKPTGKKTS

SEQ ID NO: 1568 - protein, 209 aa, Artificial Sequence
  source: /note="Description of Artificial Sequence: Synthetic polypeptide"
LEPGEKPYKCPECGKSFSTSGNLVRHQRTHTGEKPYKCPECGKSFSTSGNLTEHQRTHTGEKPYKCPECGKSFSHRTTLTNHQRTHTGEKPYKCPECGKSFSRSDELVRHQRTHTGEKPYKCPECGKSFSSKKHLAEHQRTHTGEKPYKCPECGKSFSRSDELVRHQRTHTGEKPYKCPECGKSFSQAGHLASHQRTHTGEKPTGKKTS

SEQ ID NO: 1569 - protein, 209 aa, Artificial Sequence
  source: /note="Description of Artificial Sequence: Synthetic polypeptide"
LEPGEKPYKCPECGKSFSDCRDLARHQRTHTGEKPYKCPECGKSFSTSGNLVRHQRTHTGEKPYKCPECGKSFSTSGNLTEHQRTHTGEKPYKCPECGKSFSHRTTLTNHQRTHTGEKPYKCPECGKSFSRSDELVRHQRTHTGEKPYKCPECGKSFSSKKHLAEHQRTHTGEKPYKCPECGKSFSRSDELVRHQRTHTGEKPTGKKTS

SEQ ID NO: 1570 - protein, 209 aa, Artificial Sequence
  source: /note="Description of Artificial Sequence: Synthetic polypeptide"
LEPGEKPYKCPECGKSFSDCRDLARHQRTHTGEKPYKCPECGKSFSTKNSLTEHQRTHTGEKPYKCPECGKSFSRRDELNVHQRTHTGEKPYKCPECGKSFSRRDELNVHQRTHTGEKPYKCPECGKSFSDPGALVRHQRTHTGEKPYKCPECGKSFSQAGHLASHQRTHTGEKPYKCPECGKSFSRNDTLTEHQRTHTGEKPTGKKTS

SEQ ID NO: 1571 - protein, 209 aa, Artificial Sequence
  source: /note="Description of Artificial Sequence: Synthetic polypeptide"
LEPGEKPYKCPECGKSFSDSGNLRVHQRTHTGEKPYKCPECGKSFSSPADLTRHQRTHTGEKPYKCPECGKSFSTSHSLTEHQRTHTGEKPYKCPECGKSFSQRANLRAHQRTHTGEKPYKCPECGKSFSRADNLTEHQRTHTGEKPYKCPECGKSFSERSHLREHQRTHTGEKPYKCPECGKSFSDPGALVRHQRTHTGEKPTGKKTS

SEQ ID NO: 1572 - protein, 209 aa, Artificial Sequence
  source: /note="Description of Artificial Sequence: Synthetic polypeptide"
LEPGEKPYKCPECGKSFSERSHLREHQRTHTGEKPYKCPECGKSFSDSGNLRVHQRTHTGEKPYKCPECGKSFSSPADLTRHQRTHTGEKPYKCPECGKSFSTSHSLTEHQRTHTGEKPYKCPECGKSFSQRANLRAHQRTHTGEKPYKCPECGKSFSRADNLTEHQRTHTGEKPYKCPECGKSFSERSHLREHQRTHTGEKPTGKKTS

SEQ ID NO: 1573 - protein, 209 aa, Artificial Sequence
  source: /note="Description of Artificial Sequence: Synthetic polypeptide"
LEPGEKPYKCPECGKSFSQSGNLTEHQRTHTGEKPYKCPECGKSFSERSHLREHQRTHTGEKPYKCPECGKSFSDSGNLRVHQRTHTGEKPYKCPECGKSFSSPADLTRHQRTHTGEKPYKCPECGKSFSTSHSLTEHQRTHTGEKPYKCPECGKSFSQRANLRAHQRTHTGEKPYKCPECGKSFSRADNLTEHQRTHTGEKPTGKKTS

SEQ ID NO: 1574 - protein, 209 aa, Artificial Sequence
  source: /note="Description of Artificial Sequence: Synthetic polypeptide"
LEPGEKPYKCPECGKSFSERSHLREHQRTHTGEKPYKCPECGKSFSHKNALQNHQRTHTGEKPYKCPECGKSFSQSSSLVRHQRTHTGEKPYKCPECGKSFSTSGSLVRHQRTHTGEKPYKCPECGKSFSQSGDLRRHQRTHTGEKPYKCPECGKSFSTSHSLTEHQRTHTGEKPYKCPECGKSFSDCRDLARHQRTHTGEKPTGKKTS

SEQ ID NO: 1575 - protein, 209 aa, Artificial Sequence
  source: /note="Description of Artificial Sequence: Synthetic polypeptide"
LEPGEKPYKCPECGKSFSQSGDLRRHQRTHTGEKPYKCPECGKSFSTSHSLTEHQRTHTGEKPYKCPECGKSFSDCRDLARHQRTHTGEKPYKCPECGKSFSRSDHLTNHQRTHTGEKPYKCPECGKSFSTSGSLVRHQRTHTGEKPYKCPECGKSFSQAGHLASHQRTHTGEKPYKCPECGKSFSRSDKLTEHQRTHTGEKPTGKKTS

SEQ ID NO: 1576 - protein, 209 aa, Artificial Sequence
  source: /note="Description of Artificial Sequence: Synthetic polypeptide"
LEPGEKPYKCPECGKSFSSPADLTRHQRTHTGEKPYKCPECGKSFSTSHSLTEHQRTHTGEKPYKCPECGKSFSQRANLRAHQRTHTGEKPYKCPECGKSFSRADNLTEHQRTHTGEKPYKCPECGKSFSERSHLREHQRTHTGEKPYKCPECGKSFSDPGALVRHQRTHTGEKPYKCPECGKSFSTSGHLVRHQRTHTGEKPTGKKTS

SEQ ID NO: 1577 - protein, 209 aa, Artificial Sequence
  source: /note="Description of Artificial Sequence: Synthetic polypeptide"
LEPGEKPYKCPECGKSFSHKNALQNHQRTHTGEKPYKCPECGKSFSQSSSLVRHQRTHTGEKPYKCPECGKSFSTSGSLVRHQRTHTGEKPYKCPECGKSFSQSGDLRRHQRTHTGEKPYKCPECGKSFSTSHSLTEHQRTHTGEKPYKCPECGKSFSDCRDLARHQRTHTGEKPYKCPECGKSFSRSDHLTNHQRTHTGEKPTGKKTS

SEQ ID NO: 1578 - protein, 209 aa, Artificial Sequence
  source: /note="Description of Artificial Sequence: Synthetic polypeptide"
LEPGEKPYKCPECGKSFSDKKDLTRHQRTHTGEKPYKCPECGKSFSERSHLREHQRTHTGEKPYKCPECGKSFSHKNALQNHQRTHTGEKPYKCPECGKSFSQSSSLVRHQRTHTGEKPYKCPECGKSFSTSGSLVRHQRTHTGEKPYKCPECGKSFSQSGDLRRHQRTHTGEKPYKCPECGKSFSTSHSLTEHQRTHTGEKPTGKKTS

SEQ ID NO: 1579 - protein, 209 aa, Artificial Sequence
  source: /note="Description of Artificial Sequence: Synthetic polypeptide"
LEPGEKPYKCPECGKSFSTSGSLVRHQRTHTGEKPYKCPECGKSFSQAGHLASHQRTHTGEKPYKCPECGKSFSRSDKLTEHQRTHTGEKPYKCPECGKSFSTSGNLTEHQRTHTGEKPYKCPECGKSFSQSSNLVRHQRTHTGEKPYKCPECGKSFSTHLDLIRHQRTHTGEKPYKCPECGKSFSQKSSLIAHQRTHTGEKPTGKKTS

SEQ ID NO: 1580 - protein, 209 aa, Artificial Sequence
  source: /note="Description of Artificial Sequence: Synthetic polypeptide"
LEPGEKPYKCPECGKSFSTSHSLTEHQRTHTGEKPYKCPECGKSFSDCRDLARHQRTHTGEKPYKCPECGKSFSRSDHLTNHQRTHTGEKPYKCPECGKSFSTSGSLVRHQRTHTGEKPYKCPECGKSFSQAGHLASHQRTHTGEKPYKCPECGKSFSRSDKLTEHQRTHTGEKPYKCPECGKSFSTSGNLTEHQRTHTGEKPTGKKTS

SEQ ID NO: 1581 - protein, 209 aa, Artificial Sequence
  source: /note="Description of Artificial Sequence: Synthetic polypeptide"
LEPGEKPYKCPECGKSFSDCRDLARHQRTHTGEKPYKCPECGKSFSRSDHLTNHQRTHTGEKPYKCPECGKSFSTSGSLVRHQRTHTGEKPYKCPECGKSFSQAGHLASHQRTHTGEKPYKCPECGKSFSRSDKLTEHQRTHTGEKPYKCPECGKSFSTSGNLTEHQRTHTGEKPYKCPECGKSFSQSSNLVRHQRTHTGEKPTGKKTS

SEQ ID NO: 1582 - protein, 209 aa, Artificial Sequence
  source: /note="Description of Artificial Sequence: Synthetic polypeptide"
LEPGEKPYKCPECGKSFSQRANLRAHQRTHTGEKPYKCPECGKSFSRADNLTEHQRTHTGEKPYKCPECGKSFSERSHLREHQRTHTGEKPYKCPECGKSFSDPGALVRHQRTHTGEKPYKCPECGKSFSTSGHLVRHQRTHTGEKPYKCPECGKSFSRNDTLTEHQRTHTGEKPYKCPECGKSFSDKKDLTRHQRTHTGEKPTGKKTS

SEQ ID NO: 1583 - protein, 209 aa, Artificial Sequence
  source: /note="Description of Artificial Sequence: Synthetic polypeptide"
LEPGEKPYKCPECGKSFSRADNLTEHQRTHTGEKPYKCPECGKSFSERSHLREHQRTHTGEKPYKCPECGKSFSDPGALVRHQRTHTGEKPYKCPECGKSFSTSGHLVRHQRTHTGEKPYKCPECGKSFSRNDTLTEHQRTHTGEKPYKCPECGKSFSDKKDLTRHQRTHTGEKPYKCPECGKSFSERSHLREHQRTHTGEKPTGKKTS

SEQ ID NO: 1584 - protein, 209 aa, Artificial Sequence
  source: /note="Description of Artificial Sequence: Synthetic polypeptide"
LEPGEKPYKCPECGKSFSRNDTLTEHQRTHTGEKPYKCPECGKSFSDKKDLTRHQRTHTGEKPYKCPECGKSFSERSHLREHQRTHTGEKPYKCPECGKSFSHKNALQNHQRTHTGEKPYKCPECGKSFSQSSSLVRHQRTHTGEKPYKCPECGKSFSTSGSLVRHQRTHTGEKPYKCPECGKSFSQSGDLRRHQRTHTGEKPTGKKTS

SEQ ID NO: 1585 - protein, 209 aa, Artificial Sequence
  source: /note="Description of Artificial Sequence: Synthetic polypeptide"
LEPGEKPYKCPECGKSFSERSHLREHQRTHTGEKPYKCPECGKSFSDPGALVRHQRTHTGEKPYKCPECGKSFSTSGHLVRHQRTHTGEKPYKCPECGKSFSRNDTLTEHQRTHTGEKPYKCPECGKSFSDKKDLTRHQRTHTGEKPYKCPECGKSFSERSHLREHQRTHTGEKPYKCPECGKSFSHKNALQNHQRTHTGEKPTGKKTS

SEQ ID NO: 1586 - protein, 209 aa, Artificial Sequence
  source: /note="Description of Artificial Sequence: Synthetic polypeptide"
LEPGEKPYKCPECGKSFSDPGALVRHQRTHTGEKPYKCPECGKSFSTSGHLVRHQRTHTGEKPYKCPECGKSFSRNDTLTEHQRTHTGEKPYKCPECGKSFSDKKDLTRHQRTHTGEKPYKCPECGKSFSERSHLREHQRTHTGEKPYKCPECGKSFSHKNALQNHQRTHTGEKPYKCPECGKSFSQSSSLVRHQRTHTGEKPTGKKTS

SEQ ID NO: 1587 - protein, 209 aa, Artificial Sequence
  source: /note="Description of Artificial Sequence: Synthetic polypeptide"
LEPGEKPYKCPECGKSFSTSGSLVRHQRTHTGEKPYKCPECGKSFSQSGDLRRHQRTHTGEKPYKCPECGKSFSTSHSLTEHQRTHTGEKPYKCPECGKSFSDCRDLARHQRTHTGEKPYKCPECGKSFSRSDHLTNHQRTHTGEKPYKCPECGKSFSTSGSLVRHQRTHTGEKPYKCPECGKSFSQAGHLASHQRTHTGEKPTGKKTS

SEQ ID NO: 1588 - protein, 209 aa, Artificial Sequence
  source: /note="Description of Artificial Sequence: Synthetic polypeptide"
LEPGEKPYKCPECGKSFSQSSSLVRHQRTHTGEKPYKCPECGKSFSTSGSLVRHQRTHTGEKPYKCPECGKSFSQSGDLRRHQRTHTGEKPYKCPECGKSFSTSHSLTEHQRTHTGEKPYKCPECGKSFSDCRDLARHQRTHTGEKPYKCPECGKSFSRSDHLTNHQRTHTGEKPYKCPECGKSFSTSGSLVRHQRTHTGEKPTGKKTS

SEQ ID NO: 1589 - protein, 209 aa, Artificial Sequence
  source: /note="Description of Artificial Sequence: Synthetic polypeptide"
LEPGEKPYKCPECGKSFSTSGHLVRHQRTHTGEKPYKCPECGKSFSRNDTLTEHQRTHTGEKPYKCPECGKSFSDKKDLTRHQRTHTGEKPYKCPECGKSFSERSHLREHQRTHTGEKPYKCPECGKSFSHKNALQNHQRTHTGEKPYKCPECGKSFSQSSSLVRHQRTHTGEKPYKCPECGKSFSTSGSLVRHQRTHTGEKPTGKKTS

SEQ ID NO: 1590 - protein, 209 aa, Artificial Sequence
  source: /note="Description of Artificial Sequence: Synthetic polypeptide"
LEPGEKPYKCPECGKSFSHRTTLTNHQRTHTGEKPYKCPECGKSFSERSHLREHQRTHTGEKPYKCPECGKSFSSKKHLAEHQRTHTGEKPYKCPECGKSFSDPGHLVRHQRTHTGEKPYKCPECGKSFSREDNLHTHQRTHTGEKPYKCPECGKSFSHRTTLTNHQRTHTGEKPYKCPECGKSFSRSDELVRHQRTHTGEKPTGKKTS

SEQ ID NO: 1591 - protein, 209 aa, Artificial Sequence
  source: /note="Description of Artificial Sequence: Synthetic polypeptide"
LEPGEKPYKCPECGKSFSRADNLTEHQRTHTGEKPYKCPECGKSFSQRANLRAHQRTHTGEKPYKCPECGKSFSDSGNLRVHQRTHTGEKPYKCPECGKSFSDKKDLTRHQRTHTGEKPYKCPECGKSFSQSSNLVRHQRTHTGEKPYKCPECGKSFSTSHSLTEHQRTHTGEKPYKCPECGKSFSRADNLTEHQRTHTGEKPTGKKTS

SEQ ID NO: 1592 - protein, 209 aa, Artificial Sequence
  source: /note="Description of Artificial Sequence: Synthetic polypeptide"
LEPGEKPYKCPECGKSFSTTGNLTVHQRTHTGEKPYKCPECGKSFSTSHSLTEHQRTHTGEKPYKCPECGKSFSRADNLTEHQRTHTGEKPYKCPECGKSFSQRANLRAHQRTHTGEKPYKCPECGKSFSDSGNLRVHQRTHTGEKPYKCPECGKSFSDKKDLTRHQRTHTGEKPYKCPECGKSFSQSSNLVRHQRTHTGEKPTGKKTS

SEQ ID NO: 1593 - protein, 209 aa, Artificial Sequence
  source: /note="Description of Artificial Sequence: Synthetic polypeptide"
LEPGEKPYKCPECGKSFSTSHSLTEHQRTHTGEKPYKCPECGKSFSRADNLTEHQRTHTGEKPYKCPECGKSFSQRANLRAHQRTHTGEKPYKCPECGKSFSDSGNLRVHQRTHTGEKPYKCPECGKSFSDKKDLTRHQRTHTGEKPYKCPECGKSFSQSSNLVRHQRTHTGEKPYKCPECGKSFSTSHSLTEHQRTHTGEKPTGKKTS

SEQ ID NO: 1594 - protein, 209 aa, Artificial Sequence
  source: /note="Description of Artificial Sequence: Synthetic polypeptide"
LEPGEKPYKCPECGKSFSSKKHLAEHQRTHTGEKPYKCPECGKSFSTTGNLTVHQRTHTGEKPYKCPECGKSFSTSHSLTEHQRTHTGEKPYKCPECGKSFSRADNLTEHQRTHTGEKPYKCPECGKSFSQRANLRAHQRTHTGEKPYKCPECGKSFSDSGNLRVHQRTHTGEKPYKCPECGKSFSDKKDLTRHQRTHTGEKPTGKKTS

SEQ ID NO: 1595 - protein, 209 aa, Artificial Sequence
  source: /note="Description of Artificial Sequence: Synthetic polypeptide"
LEPGEKPYKCPECGKSFSDCRDLARHQRTHTGEKPYKCPECGKSFSSPADLTRHQRTHTGEKPYKCPECGKSFSQSGNLTEHQRTHTGEKPYKCPECGKSFSQSGNLTEHQRTHTGEKPYKCPECGKSFSDSGNLRVHQRTHTGEKPYKCPECGKSFSQLAHLRAHQRTHTGEKPYKCPECGKSFSDCRDLARHQRTHTGEKPTGKKTS

SEQ ID NO: 1596 - protein, 209 aa, Artificial Sequence
  source: /note="Description of Artificial Sequence: Synthetic polypeptide"
LEPGEKPYKCPECGKSFSQRANLRAHQRTHTGEKPYKCPECGKSFSDCRDLARHQRTHTGEKPYKCPECGKSFSSPADLTRHQRTHTGEKPYKCPECGKSFSQSGNLTEHQRTHTGEKPYKCPECGKSFSQSGNLTEHQRTHTGEKPYKCPECGKSFSDSGNLRVHQRTHTGEKPYKCPECGKSFSQLAHLRAHQRTHTGEKPTGKKTS

SEQ ID NO: 1597 - protein, 209 aa, Artificial Sequence
  source: /note="Description of Artificial Sequence: Synthetic polypeptide"
LEPGEKPYKCPECGKSFSDSGNLRVHQRTHTGEKPYKCPECGKSFSHKNALQNHQRTHTGEKPYKCPECGKSFSRNDTLTEHQRTHTGEKPYKCPECGKSFSQRAHLERHQRTHTGEKPYKCPECGKSFSRSDKLVRHQRTHTGEKPYKCPECGKSFSDPGHLVRHQRTHTGEKPYKCPECGKSFSDKKDLTRHQRTHTGEKPTGKKTS

SEQ ID NO: 1598 - protein, 209 aa, Artificial Sequence
  source: /note="Description of Artificial Sequence: Synthetic polypeptide"
LEPGEKPYKCPECGKSFSRADNLTEHQRTHTGEKPYKCPECGKSFSRSDKLTEHQRTHTGEKPYKCPECGKSFSSKKHLAEHQRTHTGEKPYKCPECGKSFSTKNSLTEHQRTHTGEKPYKCPECGKSFSDKKDLTRHQRTHTGEKPYKCPECGKSFSSKKHLAEHQRTHTGEKPYKCPECGKSFSDKKDLTRHQRTHTGEKPTGKKTS

SEQ ID NO: 1599 - protein, 209 aa, Artificial Sequence
  source: /note="Description of Artificial Sequence: Synthetic polypeptide"
LEPGEKPYKCPECGKSFSTHLDLIRHQRTHTGEKPYKCPECGKSFSRKDNLKNHQRTHTGEKPYKCPECGKSFSDCRDLARHQRTHTGEKPYKCPECGKSFSREDNLHTHQRTHTGEKPYKCPECGKSFSDPGHLVRHQRTHTGEKPYKCPECGKSFSQLAHLRAHQRTHTGEKPYKCPECGKSFSSKKALTEHQRTHTGEKPTGKKTS

SEQ ID NO: 1600 - protein, 209 aa, Artificial Sequence
  source: /note="Description of Artificial Sequence: Synthetic polypeptide"
LEPGEKPYKCPECGKSFSRKDNLKNHQRTHTGEKPYKCPECGKSFSDCRDLARHQRTHTGEKPYKCPECGKSFSREDNLHTHQRTHTGEKPYKCPECGKSFSDPGHLVRHQRTHTGEKPYKCPECGKSFSQLAHLRAHQRTHTGEKPYKCPECGKSFSSKKALTEHQRTHTGEKPYKCPECGKSFSTTGALTEHQRTHTGEKPTGKKTS

SEQ ID NO: 1601 - protein, 209 aa, Artificial Sequence
  source: /note="Description of Artificial Sequence: Synthetic polypeptide"
LEPGEKPYKCPECGKSFSQLAHLRAHQRTHTGEKPYKCPECGKSFSERSHLREHQRTHTGEKPYKCPECGKSFSSKKHLAEHQRTHTGEKPYKCPECGKSFSTHLDLIRHQRTHTGEKPYKCPECGKSFSRKDNLKNHQRTHTGEKPYKCPECGKSFSDCRDLARHQRTHTGEKPYKCPECGKSFSREDNLHTHQRTHTGEKPTGKKTS

SEQ ID NO: 1602 - protein, 209 aa, Artificial Sequence
  source: /note="Description of Artificial Sequence: Synthetic polypeptide"
LEPGEKPYKCPECGKSFSERSHLREHQRTHTGEKPYKCPECGKSFSSKKHLAEHQRTHTGEKPYKCPECGKSFSTHLDLIRHQRTHTGEKPYKCPECGKSFSRKDNLKNHQRTHTGEKPYKCPECGKSFSDCRDLARHQRTHTGEKPYKCPECGKSFSREDNLHTHQRTHTGEKPYKCPECGKSFSDPGHLVRHQRTHTGEKPTGKKTS

SEQ ID NO: 1603 - protein, 209 aa, Artificial Sequence
  source: /note="Description of Artificial Sequence: Synthetic polypeptide"
LEPGEKPYKCPECGKSFSDCRDLARHQRTHTGEKPYKCPECGKSFSREDNLHTHQRTHTGEKPYKCPECGKSFSDPGHLVRHQRTHTGEKPYKCPECGKSFSQLAHLRAHQRTHTGEKPYKCPECGKSFSSKKALTEHQRTHTGEKPYKCPECGKSFSTTGALTEHQRTHTGEKPYKCPECGKSFSSKKHLAEHQRTHTGEKPTGKKTS

SEQ ID NO: 1604 - protein, 209 aa, Artificial Sequence
  source: /note="Description of Artificial Sequence: Synthetic polypeptide"
LEPGEKPYKCPECGKSFSREDNLHTHQRTHTGEKPYKCPECGKSFSDPGHLVRHQRTHTGEKPYKCPECGKSFSQLAHLRAHQRTHTGEKPYKCPECGKSFSSKKALTEHQRTHTGEKPYKCPECGKSFSTTGALTEHQRTHTGEKPYKCPECGKSFSSKKHLAEHQRTHTGEKPYKCPECGKSFSTSHSLTEHQRTHTGEKPTGKKTS

SEQ ID NO: 1605 - protein, 209 aa, Artificial Sequence
  source: /note="Description of Artificial Sequence: Synthetic polypeptide"
LEPGEKPYKCPECGKSFSDPGHLVRHQRTHTGEKPYKCPECGKSFSQLAHLRAHQRTHTGEKPYKCPECGKSFSSKKALTEHQRTHTGEKPYKCPECGKSFSTTGALTEHQRTHTGEKPYKCPECGKSFSSKKHLAEHQRTHTGEKPYKCPECGKSFSTSHSLTEHQRTHTGEKPYKCPECGKSFSTKNSLTEHQRTHTGEKPTGKKTS

SEQ ID NO: 1606 - protein, 209 aa, Artificial Sequence
  source: /note="Description of Artificial Sequence: Synthetic polypeptide"
LEPGEKPYKCPECGKSFSSKKALTEHQRTHTGEKPYKCPECGKSFSTTGALTEHQRTHTGEKPYKCPECGKSFSSKKHLAEHQRTHTGEKPYKCPECGKSFSTSHSLTEHQRTHTGEKPYKCPECGKSFSTKNSLTEHQRTHTGEKPYKCPECGKSFSRSDNLVRHQRTHTGEKPYKCPECGKSFSQSGDLRRHQRTHTGEKPTGKKTS

SEQ ID NO: 1607 - protein, 209 aa, Artificial Sequence
  source: /note="Description of Artificial Sequence: Synthetic polypeptide"
LEPGEKPYKCPECGKSFSQLAHLRAHQRTHTGEKPYKCPECGKSFSSKKALTEHQRTHTGEKPYKCPECGKSFSTTGALTEHQRTHTGEKPYKCPECGKSFSSKKHLAEHQRTHTGEKPYKCPECGKSFSTSHSLTEHQRTHTGEKPYKCPECGKSFSTKNSLTEHQRTHTGEKPYKCPECGKSFSRSDNLVRHQRTHTGEKPTGKKTS

SEQ ID NO: 1608 - protein, 209 aa, Artificial Sequence
  source: /note="Description of Artificial Sequence: Synthetic polypeptide"
LEPGEKPYKCPECGKSFSTTGALTEHQRTHTGEKPYKCPECGKSFSSKKHLAEHQRTHTGEKPYKCPECGKSFSTSHSLTEHQRTHTGEKPYKCPECGKSFSTKNSLTEHQRTHTGEKPYKCPECGKSFSRSDNLVRHQRTHTGEKPYKCPECGKSFSQSGDLRRHQRTHTGEKPYKCPECGKSFSRNDTLTEHQRTHTGEKPTGKKTS

SEQ ID NO: 1609 - protein, 209 aa, Artificial Sequence
  source: /note="Description of Artificial Sequence: Synthetic polypeptide"
LEPGEKPYKCPECGKSFSRSDKLTEHQRTHTGEKPYKCPECGKSFSQRAHLERHQRTHTGEKPYKCPECGKSFSQLAHLRAHQRTHTGEKPYKCPECGKSFSSKKHLAEHQRTHTGEKPYKCPECGKSFSTTGALTEHQRTHTGEKPYKCPECGKSFSTSGNLVRHQRTHTGEKPYKCPECGKSFSQSGDLRRHQRTHTGEKPTGKKTS

SEQ ID NO: 1610 - protein, 209 aa, Artificial Sequence
  source: /note="Description of Artificial Sequence: Synthetic polypeptide"
LEPGEKPYKCPECGKSFSRSDHLTNHQRTHTGEKPYKCPECGKSFSRSDKLVRHQRTHTGEKPYKCPECGKSFSTHLDLIRHQRTHTGEKPYKCPECGKSFSDPGHLVRHQRTHTGEKPYKCPECGKSFSRSDNLVRHQRTHTGEKPYKCPECGKSFSQLAHLRAHQRTHTGEKPYKCPECGKSFSDPGHLVRHQRTHTGEKPTGKKTS

SEQ ID NO: 1611 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSTHLDLIRHQRTHTGEKPYKCPECGKSFSDPGHLVRHQRTHTGEKPYKCPECGKSFSRSDNLVRHQRTHTGEKPYKCPECGKSFSQLAHLRAHQRTHTGEKPYKCPECGKSFSDPGHLVRHQRTHTGEKPYKCPECGKSFSQSSNLVRHQRTHTGEKPTGKKTS

SEQ ID NO: 1612 - protein, 209 aa, Artificial Sequence
  source: /note="Description of Artificial Sequence: Synthetic polypeptide"
LEPGEKPYKCPECGKSFSRADNLTEHQRTHTGEKPYKCPECGKSFSRSDHLTNHQRTHTGEKPYKCPECGKSFSRSDHLTNHQRTHTGEKPYKCPECGKSFSRSDKLVRHQRTHTGEKPYKCPECGKSFSTHLDLIRHQRTHTGEKPYKCPECGKSFSDPGHLVRHQRTHTGEKPYKCPECGKSFSRSDNLVRHQRTHTGEKPTGKKTS

SEQ ID NO: 1613 - protein, 209 aa, Artificial Sequence
  source: /note="Description of Artificial Sequence: Synthetic polypeptide"
LEPGEKPYKCPECGKSFSRSDHLTNHQRTHTGEKPYKCPECGKSFSRSDHLTNHQRTHTGEKPYKCPECGKSFSRSDKLVRHQRTHTGEKPYKCPECGKSFSTHLDLIRHQRTHTGEKPYKCPECGKSFSDPGHLVRHQRTHTGEKPYKCPECGKSFSRSDNLVRHQRTHTGEKPYKCPECGKSFSQLAHLRAHQRTHTGEKPTGKKTS

SEQ ID NO: 1614 - protein, 209 aa, Artificial Sequence
  source: /note="Description of Artificial Sequence: Synthetic polypeptide"
LEPGEKPYKCPECGKSFSDPGHLVRHQRTHTGEKPYKCPECGKSFSRSDNLVRHQRTHTGEKPYKCPECGKSFSRSDHLTTHQRTHTGEKPYKCPECGKSFSRADNLTEHQRTHTGEKPYKCPECGKSFSRSDHLTNHQRTHTGEKPYKCPECGKSFSRSDHLTNHQRTHTGEKPYKCPECGKSFSRSDKLVRHQRTHTGEKPTGKKTS

SEQ ID NO: 1615 - protein, 209 aa, Artificial Sequence
  source: /note="Description of Artificial Sequence: Synthetic polypeptide"
LEPGEKPYKCPECGKSFSRSDHLTTHQRTHTGEKPYKCPECGKSFSRADNLTEHQRTHTGEKPYKCPECGKSFSRSDHLTNHQRTHTGEKPYKCPECGKSFSRSDHLTNHQRTHTGEKPYKCPECGKSFSRSDKLVRHQRTHTGEKPYKCPECGKSFSTHLDLIRHQRTHTGEKPYKCPECGKSFSDPGHLVRHQRTHTGEKPTGKKTS

SEQ ID NO: 1616 - protein, 209 aa, Artificial Sequence
  source: /note="Description of Artificial Sequence: Synthetic polypeptide"
LEPGEKPYKCPECGKSFSTKNSLTEHQRTHTGEKPYKCPECGKSFSRSDKLVRHQRTHTGEKPYKCPECGKSFSRSDKLTEHQRTHTGEKPYKCPECGKSFSRSDKLVRHQRTHTGEKPYKCPECGKSFSQRAHLERHQRTHTGEKPYKCPECGKSFSDPGHLVRHQRTHTGEKPYKCPECGKSFSRSDNLVRHQRTHTGEKPTGKKTS

SEQ ID NO: 1617 - protein, 209 aa, Artificial Sequence
  source: /note="Description of Artificial Sequence: Synthetic polypeptide"
LEPGEKPYKCPECGKSFSRSDNLVRHQRTHTGEKPYKCPECGKSFSRSDHLTTHQRTHTGEKPYKCPECGKSFSRADNLTEHQRTHTGEKPYKCPECGKSFSRSDHLTNHQRTHTGEKPYKCPECGKSFSRSDHLTNHQRTHTGEKPYKCPECGKSFSRSDKLVRHQRTHTGEKPYKCPECGKSFSTHLDLIRHQRTHTGEKPTGKKTS

SEQ ID NO: 1618 - protein, 209 aa, Artificial Sequence
  source: /note="Description of Artificial Sequence: Synthetic polypeptide"
LEPGEKPYKCPECGKSFSDPGHLVRHQRTHTGEKPYKCPECGKSFSRSDNLVRHQRTHTGEKPYKCPECGKSFSQLAHLRAHQRTHTGEKPYKCPECGKSFSDPGHLVRHQRTHTGEKPYKCPECGKSFSQSSNLVRHQRTHTGEKPYKCPECGKSFSRKDNLKNHQRTHTGEKPYKCPECGKSFSQAGHLASHQRTHTGEKPTGKKTS

SEQ ID NO: 1619 - protein, 209 aa, Artificial Sequence
  source: /note="Description of Artificial Sequence: Synthetic polypeptide"
LEPGEKPYKCPECGKSFSTHLDLIRHQRTHTGEKPYKCPECGKSFSDPGHLVRHQRTHTGEKPYKCPECGKSFSRSDNLVRHQRTHTGEKPYKCPECGKSFSQLAHLRAHQRTHTGEKPYKCPECGKSFSDPGHLVRHQRTHTGEKPYKCPECGKSFSQSSNLVRHQRTHTGEKPYKCPECGKSFSRKDNLKNHQRTHTGEKPTGKKTS

SEQ ID NO: 1620 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSRSDKLTEHQRTHTGEKPYKCPECGKSFSRSDKLVRHQRTHTGEKPYKCPECGKSFSQRAHLERHQRTHTGEKPYKCPECGKSFSDPGHLVRHQRTHTGEKPYKCPECGKSFSRSDNLVRHQRTHTGEKPYKCPECGKSFSRSDHLTTHQRTHTGEKPTGKKTS

SEQ ID NO: 1621 - protein, 209 aa, Artificial Sequence
  source: /note="Description of Artificial Sequence: Synthetic polypeptide"
LEPGEKPYKCPECGKSFSRSDKLTEHQRTHTGEKPYKCPECGKSFSRSDKLVRHQRTHTGEKPYKCPECGKSFSQRAHLERHQRTHTGEKPYKCPECGKSFSDPGHLVRHQRTHTGEKPYKCPECGKSFSRSDNLVRHQRTHTGEKPYKCPECGKSFSRSDHLTTHQRTHTGEKPYKCPECGKSFSRADNLTEHQRTHTGEKPTGKKTS

SEQ ID NO: 1622 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSQRAHLERHQRTHTGEKPYKCPECGKSFSDPGHLVRHQRTHTGEKPYKCPECGKSFSRSDNLVRHQRTHTGEKPYKCPECGKSFSRSDHLTTHQRTHTGEKPYKCPECGKSFSRADNLTEHQRTHTGEKPYKCPECGKSFSRSDHLTNHQRTHTGEKPTGKKTS

SEQ ID NO: 1623 - protein, 209 aa, Artificial Sequence
  source: /note="Description of Artificial Sequence: Synthetic polypeptide"
LEPGEKPYKCPECGKSFSQRAHLERHQRTHTGEKPYKCPECGKSFSDPGHLVRHQRTHTGEKPYKCPECGKSFSRSDNLVRHQRTHTGEKPYKCPECGKSFSRSDHLTTHQRTHTGEKPYKCPECGKSFSRADNLTEHQRTHTGEKPYKCPECGKSFSRSDHLTNHQRTHTGEKPYKCPECGKSFSRSDHLTNHQRTHTGEKPTGKKTS

SEQ ID NO: 1624 - protein, 209 aa, Artificial Sequence
  source: /note="Description of Artificial Sequence: Synthetic polypeptide"
LEPGEKPYKCPECGKSFSQLAHLRAHQRTHTGEKPYKCPECGKSFSDPGHLVRHQRTHTGEKPYKCPECGKSFSQSSNLVRHQRTHTGEKPYKCPECGKSFSRKDNLKNHQRTHTGEKPYKCPECGKSFSQAGHLASHQRTHTGEKPYKCPECGKSFSTSGSLVRHQRTHTGEKPYKCPECGKSFSRTDTLRDHQRTHTGEKPTGKKTS

SEQ ID NO: 1625 - protein, 209 aa, Artificial Sequence
  source: /note="Description of Artificial Sequence: Synthetic polypeptide"
LEPGEKPYKCPECGKSFSDPGHLVRHQRTHTGEKPYKCPECGKSFSQSSNLVRHQRTHTGEKPYKCPECGKSFSRKDNLKNHQRTHTGEKPYKCPECGKSFSQAGHLASHQRTHTGEKPYKCPECGKSFSTSGSLVRHQRTHTGEKPYKCPECGKSFSRTDTLRDHQRTHTGEKPYKCPECGKSFSRSDHLTNHQRTHTGEKPTGKKTS

SEQ ID NO: 1626 - protein, 209 aa, Artificial Sequence
  source: /note="Description of Artificial Sequence: Synthetic polypeptide"
LEPGEKPYKCPECGKSFSQSSNLVRHQRTHTGEKPYKCPECGKSFSRKDNLKNHQRTHTGEKPYKCPECGKSFSQAGHLASHQRTHTGEKPYKCPECGKSFSTSGSLVRHQRTHTGEKPYKCPECGKSFSRTDTLRDHQRTHTGEKPYKCPECGKSFSRSDHLTNHQRTHTGEKPYKCPECGKSFSRADNLTEHQRTHTGEKPTGKKTS

SEQ ID NO: 1627 - protein, 209 aa, Artificial Sequence
  source: /note="Description of Artificial Sequence: Synthetic polypeptide"
LEPGEKPYKCPECGKSFSRSDHLTNHQRTHTGEKPYKCPECGKSFSDPGHLVRHQRTHTGEKPYKCPECGKSFSREDNLHTHQRTHTGEKPYKCPECGKSFSRSDKLVRHQRTHTGEKPYKCPECGKSFSTSHSLTEHQRTHTGEKPYKCPECGKSFSHTGHLLEHQRTHTGEKPYKCPECGKSFSRSDKLVRHQRTHTGEKPTGKKTS

SEQ ID NO: 1628 - protein, 209 aa, Artificial Sequence
  source: /note="Description of Artificial Sequence: Synthetic polypeptide"
LEPGEKPYKCPECGKSFSRSDHLTTHQRTHTGEKPYKCPECGKSFSRSDHLTNHQRTHTGEKPYKCPECGKSFSDPGHLVRHQRTHTGEKPYKCPECGKSFSREDNLHTHQRTHTGEKPYKCPECGKSFSRSDKLVRHQRTHTGEKPYKCPECGKSFSTSHSLTEHQRTHTGEKPYKCPECGKSFSHTGHLLEHQRTHTGEKPTGKKTS

SEQ ID NO: 1629 - protein, 209 aa, Artificial Sequence
  source: /note="Description of Artificial Sequence: Synthetic polypeptide"
LEPGEKPYKCPECGKSFSDPGHLVRHQRTHTGEKPYKCPECGKSFSRSDKLVRHQRTHTGEKPYKCPECGKSFSDPGHLVRHQRTHTGEKPYKCPECGKSFSRSDNLVRHQRTHTGEKPYKCPECGKSFSRSDDLVRHQRTHTGEKPYKCPECGKSFSRSDHLTNHQRTHTGEKPYKCPECGKSFSRSDKLVRHQRTHTGEKPTGKKTS

SEQ ID NO: 1630 - protein, 209 aa, Artificial Sequence
  source: /note="Description of Artificial Sequence: Synthetic polypeptide"
LEPGEKPYKCPECGKSFSTTGNLTVHQRTHTGEKPYKCPECGKSFSRSDNLVRHQRTHTGEKPYKCPECGKSFSRSDHLTNHQRTHTGEKPYKCPECGKSFSDPGHLVRHQRTHTGEKPYKCPECGKSFSQRAHLERHQRTHTGEKPYKCPECGKSFSSRRTCRAHQRTHTGEKPYKCPECGKSFSRSDKLTEHQRTHTGEKPTGKKTS

SEQ ID NO: 1631 - protein, 209 aa, Artificial Sequence
  source: /note="Description of Artificial Sequence: Synthetic polypeptide"
LEPGEKPYKCPECGKSFSRNDALTEHQRTHTGEKPYKCPECGKSFSQSGDLRRHQRTHTGEKPYKCPECGKSFSRSDHLTNHQRTHTGEKPYKCPECGKSFSRSDNLVRHQRTHTGEKPYKCPECGKSFSQSGDLRRHQRTHTGEKPYKCPECGKSFSRKDNLKNHQRTHTGEKPYKCPECGKSFSRSDHLTNHQRTHTGEKPTGKKTS

SEQ ID NO: 1632 - protein, 209 aa, Artificial Sequence
  source: /note="Description of Artificial Sequence: Synthetic polypeptide"
LEPGEKPYKCPECGKSFSSRRTCRAHQRTHTGEKPYKCPECGKSFSRSDKLTEHQRTHTGEKPYKCPECGKSFSRNDTLTEHQRTHTGEKPYKCPECGKSFSRSDHLTTHQRTHTGEKPYKCPECGKSFSRSDHLTNHQRTHTGEKPYKCPECGKSFSDPGHLVRHQRTHTGEKPYKCPECGKSFSREDNLHTHQRTHTGEKPTGKKTS

SEQ ID NO: 1633 - protein, 209 aa, Artificial Sequence
  source: /note="Description of Artificial Sequence: Synthetic polypeptide"
LEPGEKPYKCPECGKSFSRSDKLTEHQRTHTGEKPYKCPECGKSFSRNDTLTEHQRTHTGEKPYKCPECGKSFSRSDHLTTHQRTHTGEKPYKCPECGKSFSRSDHLTNHQRTHTGEKPYKCPECGKSFSDPGHLVRHQRTHTGEKPYKCPECGKSFSREDNLHTHQRTHTGEKPYKCPECGKSFSRSDKLVRHQRTHTGEKPTGKKTS

SEQ ID NO: 1634 - protein, 209 aa, Artificial Sequence
  source: /note="Description of Artificial Sequence: Synthetic polypeptide"
LEPGEKPYKCPECGKSFSRNDTLTEHQRTHTGEKPYKCPECGKSFSRSDHLTTHQRTHTGEKPYKCPECGKSFSRSDHLTNHQRTHTGEKPYKCPECGKSFSDPGHLVRHQRTHTGEKPYKCPECGKSFSREDNLHTHQRTHTGEKPYKCPECGKSFSRSDKLVRHQRTHTGEKPYKCPECGKSFSTSHSLTEHQRTHTGEKPTGKKTS

SEQ ID NO: 1635 - protein, 209 aa, Artificial Sequence
  source: /note="Description of Artificial Sequence: Synthetic polypeptide"
LEPGEKPYKCPECGKSFSRSDKLTEHQRTHTGEKPYKCPECGKSFSTTGALTEHQRTHTGEKPYKCPECGKSFSDPGHLVRHQRTHTGEKPYKCPECGKSFSRSDKLVRHQRTHTGEKPYKCPECGKSFSDPGHLVRHQRTHTGEKPYKCPECGKSFSRSDNLVRHQRTHTGEKPYKCPECGKSFSRSDDLVRHQRTHTGEKPTGKKTS

SEQ ID NO: 1636 - protein, 209 aa, Artificial Sequence
  source: /note="Description of Artificial Sequence: Synthetic polypeptide"
LEPGEKPYKCPECGKSFSQSGDLRRHQRTHTGEKPYKCPECGKSFSRSDHLTNHQRTHTGEKPYKCPECGKSFSRSDNLVRHQRTHTGEKPYKCPECGKSFSQSGDLRRHQRTHTGEKPYKCPECGKSFSRKDNLKNHQRTHTGEKPYKCPECGKSFSRSDHLTNHQRTHTGEKPYKCPECGKSFSQSSNLVRHQRTHTGEKPTGKKTS

SEQ ID NO: 1637 - protein, 209 aa, Artificial Sequence
  source: /note="Description of Artificial Sequence: Synthetic polypeptide"
LEPGEKPYKCPECGKSFSDPGHLVRHQRTHTGEKPYKCPECGKSFSRSDNLVRHQRTHTGEKPYKCPECGKSFSRSDDLVRHQRTHTGEKPYKCPECGKSFSRSDHLTNHQRTHTGEKPYKCPECGKSFSRSDKLVRHQRTHTGEKPYKCPECGKSFSHRTTLTNHQRTHTGEKPYKCPECGKSFSDPGHLVRHQRTHTGEKPTGKKTS

SEQ ID NO: 1638 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSDPGHLVRHQRTHTGEKPYKCPECGKSFSRSDNLVRHQRTHTGEKPYKCPECGKSFSRSDDLVRHQRTHTGEKPYKCPECGKSFSRSDHLTNHQRTHTGEKPYKCPECGKSFSRSDKLVRHQRTHTGEKPYKCPECGKSFSHRTTLTNHQRTHTGEKPTGKKTS

SEQ ID NO: 1639 - protein, 209 aa, Artificial Sequence
  source: /note="Description of Artificial Sequence: Synthetic polypeptide"
LEPGEKPYKCPECGKSFSTTGALTEHQRTHTGEKPYKCPECGKSFSDPGHLVRHQRTHTGEKPYKCPECGKSFSRSDKLVRHQRTHTGEKPYKCPECGKSFSDPGHLVRHQRTHTGEKPYKCPECGKSFSRSDNLVRHQRTHTGEKPYKCPECGKSFSRSDDLVRHQRTHTGEKPYKCPECGKSFSRSDHLTNHQRTHTGEKPTGKKTS

SEQ ID NO: 1640 - protein, 209 aa, Artificial Sequence
  source: /note="Description of Artificial Sequence: Synthetic polypeptide"
LEPGEKPYKCPECGKSFSQRAHLERHQRTHTGEKPYKCPECGKSFSRNDALTEHQRTHTGEKPYKCPECGKSFSQSGDLRRHQRTHTGEKPYKCPECGKSFSRSDHLTNHQRTHTGEKPYKCPECGKSFSRSDNLVRHQRTHTGEKPYKCPECGKSFSQSGDLRRHQRTHTGEKPYKCPECGKSFSRKDNLKNHQRTHTGEKPTGKKTS

SEQ ID NO: 1641 - protein, 209 aa, Artificial Sequence
  source: /note="Description of Artificial Sequence: Synthetic polypeptide"
LEPGEKPYKCPECGKSFSRSDDLVRHQRTHTGEKPYKCPECGKSFSTTGNLTVHQRTHTGEKPYKCPECGKSFSRSDNLVRHQRTHTGEKPYKCPECGKSFSRSDHLTNHQRTHTGEKPYKCPECGKSFSDPGHLVRHQRTHTGEKPYKCPECGKSFSQRAHLERHQRTHTGEKPYKCPECGKSFSSRRTCRAHQRTHTGEKPTGKKTS

SEQ ID NO: 1642 - protein, 209 aa, Artificial Sequence
  source: /note="Description of Artificial Sequence: Synthetic polypeptide"
LEPGEKPYKCPECGKSFSQRAHLERHQRTHTGEKPYKCPECGKSFSQRAHLERHQRTHTGEKPYKCPECGKSFSRNDALTEHQRTHTGEKPYKCPECGKSFSQSGDLRRHQRTHTGEKPYKCPECGKSFSRSDHLTNHQRTHTGEKPYKCPECGKSFSRSDNLVRHQRTHTGEKPYKCPECGKSFSQSGDLRRHQRTHTGEKPTGKKTS

SEQ ID NO: 1643 - protein, 209 aa, Artificial Sequence
  source: /note="Description of Artificial Sequence: Synthetic polypeptide"
LEPGEKPYKCPECGKSFSDPGHLVRHQRTHTGEKPYKCPECGKSFSQRAHLERHQRTHTGEKPYKCPECGKSFSQRAHLERHQRTHTGEKPYKCPECGKSFSRNDALTEHQRTHTGEKPYKCPECGKSFSQSGDLRRHQRTHTGEKPYKCPECGKSFSRSDHLTNHQRTHTGEKPYKCPECGKSFSRSDNLVRHQRTHTGEKPTGKKTS

SEQ ID NO: 1644 - protein, 209 aa, Artificial Sequence
  source: /note="Description of Artificial Sequence: Synthetic polypeptide"
LEPGEKPYKCPECGKSFSDPGHLVRHQRTHTGEKPYKCPECGKSFSQRAHLERHQRTHTGEKPYKCPECGKSFSSRRTCRAHQRTHTGEKPYKCPECGKSFSRSDKLTEHQRTHTGEKPYKCPECGKSFSRNDTLTEHQRTHTGEKPYKCPECGKSFSRSDHLTTHQRTHTGEKPYKCPECGKSFSRSDHLTNHQRTHTGEKPTGKKTS

SEQ ID NO: 1645 - protein, 209 aa, Artificial Sequence
  source: /note="Description of Artificial Sequence: Synthetic polypeptide"
LEPGEKPYKCPECGKSFSRSDHLTNHQRTHTGEKPYKCPECGKSFSDPGHLVRHQRTHTGEKPYKCPECGKSFSQRAHLERHQRTHTGEKPYKCPECGKSFSSRRTCRAHQRTHTGEKPYKCPECGKSFSRSDKLTEHQRTHTGEKPYKCPECGKSFSRNDTLTEHQRTHTGEKPYKCPECGKSFSRSDHLTTHQRTHTGEKPTGKKTS

SEQ ID NO: 1646 - protein, 209 aa, Artificial Sequence
  source: /note="Description of Artificial Sequence: Synthetic polypeptide"
LEPGEKPYKCPECGKSFSQRAHLERHQRTHTGEKPYKCPECGKSFSSRRTCRAHQRTHTGEKPYKCPECGKSFSRSDKLTEHQRTHTGEKPYKCPECGKSFSRNDTLTEHQRTHTGEKPYKCPECGKSFSRSDHLTTHQRTHTGEKPYKCPECGKSFSRSDHLTNHQRTHTGEKPYKCPECGKSFSDPGHLVRHQRTHTGEKPTGKKTS

SEQ ID NO: 1647 - protein, 209 aa, Artificial Sequence
  source: /note="Description of Artificial Sequence: Synthetic polypeptide"
LEPGEKPYKCPECGKSFSTHLDLIRHQRTHTGEKPYKCPECGKSFSRSDDLVRHQRTHTGEKPYKCPECGKSFSTTGNLTVHQRTHTGEKPYKCPECGKSFSRSDNLVRHQRTHTGEKPYKCPECGKSFSRSDHLTNHQRTHTGEKPYKCPECGKSFSDPGHLVRHQRTHTGEKPYKCPECGKSFSQRAHLERHQRTHTGEKPTGKKTS

SEQ ID NO: 1648 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSHRTTLTNHQRTHTGEKPYKCPECGKSFSDPGHLVRHQRTHTGEKPYKCPECGKSFSQRAHLERHQRTHTGEKPYKCPECGKSFSQRAHLERHQRTHTGEKPYKCPECGKSFSRNDALTEHQRTHTGEKPYKCPECGKSFSQSGDLRRHQRTHTGEKPTGKKTS

SEQ ID NO: 1649 - protein, 209 aa, Artificial Sequence
  source: /note="Description of Artificial Sequence: Synthetic polypeptide"
LEPGEKPYKCPECGKSFSRSDNLVRHQRTHTGEKPYKCPECGKSFSRSDDLVRHQRTHTGEKPYKCPECGKSFSRSDHLTNHQRTHTGEKPYKCPECGKSFSRSDKLVRHQRTHTGEKPYKCPECGKSFSHRTTLTNHQRTHTGEKPYKCPECGKSFSDPGHLVRHQRTHTGEKPYKCPECGKSFSQRAHLERHQRTHTGEKPTGKKTS

SEQ ID NO: 1650 - protein, 209 aa, Artificial Sequence
  source: /note="Description of Artificial Sequence: Synthetic polypeptide"
LEPGEKPYKCPECGKSFSHRTTLTNHQRTHTGEKPYKCPECGKSFSDPGHLVRHQRTHTGEKPYKCPECGKSFSQRAHLERHQRTHTGEKPYKCPECGKSFSQRAHLERHQRTHTGEKPYKCPECGKSFSRNDALTEHQRTHTGEKPYKCPECGKSFSQSGDLRRHQRTHTGEKPYKCPECGKSFSRSDHLTNHQRTHTGEKPTGKKTS

SEQ ID NO: 1651 - protein, 209 aa, Artificial Sequence
  source: /note="Description of Artificial Sequence: Synthetic polypeptide"
LEPGEKPYKCPECGKSFSRSDHLTNHQRTHTGEKPYKCPECGKSFSRSDKLVRHQRTHTGEKPYKCPECGKSFSHRTTLTNHQRTHTGEKPYKCPECGKSFSDPGHLVRHQRTHTGEKPYKCPECGKSFSQRAHLERHQRTHTGEKPYKCPECGKSFSQRAHLERHQRTHTGEKPYKCPECGKSFSRNDALTEHQRTHTGEKPTGKKTS

SEQ ID NO: 1652 - protein, 209 aa, Artificial Sequence
  source: /note="Description of Artificial Sequence: Synthetic polypeptide"
LEPGEKPYKCPECGKSFSDPGHLVRHQRTHTGEKPYKCPECGKSFSREDNLHTHQRTHTGEKPYKCPECGKSFSRSDKLVRHQRTHTGEKPYKCPECGKSFSTSHSLTEHQRTHTGEKPYKCPECGKSFSHTGHLLEHQRTHTGEKPYKCPECGKSFSRSDKLVRHQRTHTGEKPYKCPECGKSFSTSGHLVRHQRTHTGEKPTGKKTS

SEQ ID NO: 1653 - protein, 209 aa, Artificial Sequence
  source: /note="Description of Artificial Sequence: Synthetic polypeptide"
LEPGEKPYKCPECGKSFSREDNLHTHQRTHTGEKPYKCPECGKSFSRSDKLVRHQRTHTGEKPYKCPECGKSFSTSHSLTEHQRTHTGEKPYKCPECGKSFSHTGHLLEHQRTHTGEKPYKCPECGKSFSRSDKLVRHQRTHTGEKPYKCPECGKSFSTSGHLVRHQRTHTGEKPYKCPECGKSFSRSDKLTEHQRTHTGEKPTGKKTS

SEQ ID NO: 1654 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSTSGHLVRHQRTHTGEKPYKCPECGKSFSRSDKLTEHQRTHTGEKPYKCPECGKSFSTTGALTEHQRTHTGEKPYKCPECGKSFSDPGHLVRHQRTHTGEKPYKCPECGKSFSRSDKLVRHQRTHTGEKPYKCPECGKSFSDPGHLVRHQRTHTGEKPTGKKTS

SEQ ID NO: 1655 - protein, 209 aa, Artificial Sequence
  source: /note="Description of Artificial Sequence: Synthetic polypeptide"
LEPGEKPYKCPECGKSFSTSGHLVRHQRTHTGEKPYKCPECGKSFSRSDKLTEHQRTHTGEKPYKCPECGKSFSTTGALTEHQRTHTGEKPYKCPECGKSFSDPGHLVRHQRTHTGEKPYKCPECGKSFSRSDKLVRHQRTHTGEKPYKCPECGKSFSDPGHLVRHQRTHTGEKPYKCPECGKSFSRSDNLVRHQRTHTGEKPTGKKTS

SEQ ID NO: 1656 - protein, 209 aa, Artificial Sequence
  source: /note="Description of Artificial Sequence: Synthetic polypeptide"
LEPGEKPYKCPECGKSFSHTGHLLEHQRTHTGEKPYKCPECGKSFSRSDKLVRHQRTHTGEKPYKCPECGKSFSTSGHLVRHQRTHTGEKPYKCPECGKSFSRSDKLTEHQRTHTGEKPYKCPECGKSFSTTGALTEHQRTHTGEKPYKCPECGKSFSDPGHLVRHQRTHTGEKPYKCPECGKSFSRSDKLVRHQRTHTGEKPTGKKTS

SEQ ID NO: 1657 - protein, 209 aa, Artificial Sequence
  source: /note="Description of Artificial Sequence: Synthetic polypeptide"
LEPGEKPYKCPECGKSFSRSDDLVRHQRTHTGEKPYKCPECGKSFSRSDHLTNHQRTHTGEKPYKCPECGKSFSRSDKLVRHQRTHTGEKPYKCPECGKSFSHRTTLTNHQRTHTGEKPYKCPECGKSFSDPGHLVRHQRTHTGEKPYKCPECGKSFSQRAHLERHQRTHTGEKPYKCPECGKSFSQRAHLERHQRTHTGEKPTGKKTS

SEQ ID NO: 1658 - protein, 209 aa, Artificial Sequence
  source: /note="Description of Artificial Sequence: Synthetic polypeptide"
LEPGEKPYKCPECGKSFSTSHSLTEHQRTHTGEKPYKCPECGKSFSHTGHLLEHQRTHTGEKPYKCPECGKSFSRSDKLVRHQRTHTGEKPYKCPECGKSFSTSGHLVRHQRTHTGEKPYKCPECGKSFSRSDKLTEHQRTHTGEKPYKCPECGKSFSTTGALTEHQRTHTGEKPYKCPECGKSFSDPGHLVRHQRTHTGEKPTGKKTS

SEQ ID NO: 1659 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSTSHSLTEHQRTHTGEKPYKCPECGKSFSHTGHLLEHQRTHTGEKPYKCPECGKSFSRSDKLVRHQRTHTGEKPYKCPECGKSFSTSGHLVRHQRTHTGEKPYKCPECGKSFSRSDKLTEHQRTHTGEKPYKCPECGKSFSTTGALTEHQRTHTGEKPTGKKTS

SEQ ID NO: 1660 - protein, 209 aa, Artificial Sequence
  source: /note="Description of Artificial Sequence: Synthetic polypeptide"
LEPGEKPYKCPECGKSFSRSDNLVRHQRTHTGEKPYKCPECGKSFSRSDNLVRHQRTHTGEKPYKCPECGKSFSRSDHLTTHQRTHTGEKPYKCPECGKSFSSKKALTEHQRTHTGEKPYKCPECGKSFSRSDKLVRHQRTHTGEKPYKCPECGKSFSQLAHLRAHQRTHTGEKPYKCPECGKSFSRADNLTEHQRTHTGEKPTGKKTS

SEQ ID NO: 1661 - protein, 209 aa, Artificial Sequence
  source: /note="Description of Artificial Sequence: Synthetic polypeptide"
LEPGEKPYKCPECGKSFSQSGDLRRHQRTHTGEKPYKCPECGKSFSRSDNLVRHQRTHTGEKPYKCPECGKSFSRSDNLVRHQRTHTGEKPYKCPECGKSFSRSDHLTTHQRTHTGEKPYKCPECGKSFSSKKALTEHQRTHTGEKPYKCPECGKSFSRSDKLVRHQRTHTGEKPYKCPECGKSFSQLAHLRAHQRTHTGEKPTGKKTS

SEQ ID NO: 1662 - protein, 209 aa, Artificial Sequence
  source: /note="Description of Artificial Sequence: Synthetic polypeptide"
LEPGEKPYKCPECGKSFSRSDELVRHQRTHTGEKPYKCPECGKSFSQSGDLRRHQRTHTGEKPYKCPECGKSFSRSDNLVRHQRTHTGEKPYKCPECGKSFSRSDNLVRHQRTHTGEKPYKCPECGKSFSRSDHLTTHQRTHTGEKPYKCPECGKSFSSKKALTEHQRTHTGEKPYKCPECGKSFSRSDKLVRHQRTHTGEKPTGKKTS

SEQ ID NO: 1663 - protein, 209 aa, Artificial Sequence
  source: /note="Description of Artificial Sequence: Synthetic polypeptide"
LEPGEKPYKCPECGKSFSRSDNLVRHQRTHTGEKPYKCPECGKSFSRSDHLTTHQRTHTGEKPYKCPECGKSFSSKKALTEHQRTHTGEKPYKCPECGKSFSRSDKLVRHQRTHTGEKPYKCPECGKSFSQLAHLRAHQRTHTGEKPYKCPECGKSFSRADNLTEHQRTHTGEKPYKCPECGKSFSRSDHLTNHQRTHTGEKPTGKKTS

SEQ ID NO: 1664 - protein, 209 aa, Artificial Sequence
  source: /note="Description of Artificial Sequence: Synthetic polypeptide"
LEPGEKPYKCPECGKSFSRSDKLTEHQRTHTGEKPYKCPECGKSFSRSDKLVRHQRTHTGEKPYKCPECGKSFSQRAHLERHQRTHTGEKPYKCPECGKSFSRSDELVRHQRTHTGEKPYKCPECGKSFSQSGDLRRHQRTHTGEKPYKCPECGKSFSRSDNLVRHQRTHTGEKPYKCPECGKSFSRSDNLVRHQRTHTGEKPTGKKTS

SEQ ID NO: 1665 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSQRAHLERHQRTHTGEKPYKCPECGKSFSRSDELVRHQRTHTGEKPYKCPECGKSFSQSGDLRRHQRTHTGEKPYKCPECGKSFSRSDNLVRHQRTHTGEKPYKCPECGKSFSRSDNLVRHQRTHTGEKPYKCPECGKSFSRSDHLTTHQRTHTGEKPTGKKTS

SEQ ID NO: 1666 - protein, 209 aa, Artificial Sequence
  source: /note="Description of Artificial Sequence: Synthetic polypeptide"
LEPGEKPYKCPECGKSFSRSDHLTNHQRTHTGEKPYKCPECGKSFSRSDKLTEHQRTHTGEKPYKCPECGKSFSRSDKLVRHQRTHTGEKPYKCPECGKSFSQRAHLERHQRTHTGEKPYKCPECGKSFSRSDELVRHQRTHTGEKPYKCPECGKSFSQSGDLRRHQRTHTGEKPYKCPECGKSFSRSDNLVRHQRTHTGEKPTGKKTS

SEQ ID NO: 1667 - protein, 209 aa, Artificial Sequence
  source: /note="Description of Artificial Sequence: Synthetic polypeptide"
LEPGEKPYKCPECGKSFSQRAHLERHQRTHTGEKPYKCPECGKSFSRSDELVRHQRTHTGEKPYKCPECGKSFSQSGDLRRHQRTHTGEKPYKCPECGKSFSRSDNLVRHQRTHTGEKPYKCPECGKSFSRSDNLVRHQRTHTGEKPYKCPECGKSFSRSDHLTTHQRTHTGEKPYKCPECGKSFSSKKALTEHQRTHTGEKPTGKKTS

SEQ ID NO: 1668 - protein, 209 aa, Artificial Sequence
  source: /note="Description of Artificial Sequence: Synthetic polypeptide"
LEPGEKPYKCPECGKSFSSKKALTEHQRTHTGEKPYKCPECGKSFSRSDKLVRHQRTHTGEKPYKCPECGKSFSQLAHLRAHQRTHTGEKPYKCPECGKSFSRADNLTEHQRTHTGEKPYKCPECGKSFSRSDHLTNHQRTHTGEKPYKCPECGKSFSQRAHLERHQRTHTGEKPYKCPECGKSFSQRANLRAHQRTHTGEKPTGKKTS

SEQ ID NO: 1669 - protein, 209 aa, Artificial Sequence
  source: /note="Description of Artificial Sequence: Synthetic polypeptide"
LEPGEKPYKCPECGKSFSRSDHLTTHQRTHTGEKPYKCPECGKSFSSKKALTEHQRTHTGEKPYKCPECGKSFSRSDKLVRHQRTHTGEKPYKCPECGKSFSQLAHLRAHQRTHTGEKPYKCPECGKSFSRADNLTEHQRTHTGEKPYKCPECGKSFSRSDHLTNHQRTHTGEKPYKCPECGKSFSQRAHLERHQRTHTGEKPTGKKTS

SEQ ID NO: 1670 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSRSDDLVRHQRTHTGEKPYKCPECGKSFSRSDHLTNHQRTHTGEKPYKCPECGKSFSRSDKLTEHQRTHTGEKPYKCPECGKSFSRSDKLVRHQRTHTGEKPYKCPECGKSFSQRAHLERHQRTHTGEKPYKCPECGKSFSRSDELVRHQRTHTGEKPTGKKTS

SEQ ID NO: 1671 - protein, 209 aa, Artificial Sequence
  source: /note="Description of Artificial Sequence: Synthetic polypeptide"
LEPGEKPYKCPECGKSFSRSDDLVRHQRTHTGEKPYKCPECGKSFSRSDHLTNHQRTHTGEKPYKCPECGKSFSRSDKLTEHQRTHTGEKPYKCPECGKSFSRSDKLVRHQRTHTGEKPYKCPECGKSFSQRAHLERHQRTHTGEKPYKCPECGKSFSRSDELVRHQRTHTGEKPYKCPECGKSFSQSGDLRRHQRTHTGEKPTGKKTS

SEQ ID NO: 1672 - protein, 209 aa, Artificial Sequence
  source: /note="Description of Artificial Sequence: Synthetic polypeptide"
LEPGEKPYKCPECGKSFSDCRDLARHQRTHTGEKPYKCPECGKSFSRSDKLVRHQRTHTGEKPYKCPECGKSFSRSDDLVRHQRTHTGEKPYKCPECGKSFSRSDHLTNHQRTHTGEKPYKCPECGKSFSRSDKLTEHQRTHTGEKPYKCPECGKSFSRSDKLVRHQRTHTGEKPYKCPECGKSFSQRAHLERHQRTHTGEKPTGKKTS

SEQ ID NO: 1673 - protein, 209 aa, Artificial Sequence
  source: /note="Description of Artificial Sequence: Synthetic polypeptide"
LEPGEKPYKCPECGKSFSQLAHLRAHQRTHTGEKPYKCPECGKSFSRSDKLVRHQRTHTGEKPYKCPECGKSFSQSGDLRRHQRTHTGEKPYKCPECGKSFSRSDNLVRHQRTHTGEKPYKCPECGKSFSRSDELVRHQRTHTGEKPYKCPECGKSFSDPGHLVRHQRTHTGEKPYKCPECGKSFSHTGHLLEHQRTHTGEKPTGKKTS

SEQ ID NO: 1674 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSQSGDLRRHQRTHTGEKPYKCPECGKSFSRSDNLVRHQRTHTGEKPYKCPECGKSFSRSDELVRHQRTHTGEKPYKCPECGKSFSDPGHLVRHQRTHTGEKPYKCPECGKSFSHTGHLLEHQRTHTGEKPYKCPECGKSFSDPGHLVRHQRTHTGEKPTGKKTS

SEQ ID NO: 1675 - protein, 209 aa, Artificial Sequence
  source: /note="Description of Artificial Sequence: Synthetic polypeptide"
LEPGEKPYKCPECGKSFSRRDELNVHQRTHTGEKPYKCPECGKSFSQLAHLRAHQRTHTGEKPYKCPECGKSFSRSDKLVRHQRTHTGEKPYKCPECGKSFSQSGDLRRHQRTHTGEKPYKCPECGKSFSRSDNLVRHQRTHTGEKPYKCPECGKSFSRSDELVRHQRTHTGEKPYKCPECGKSFSDPGHLVRHQRTHTGEKPTGKKTS

SEQ ID NO: 1676 - protein, 209 aa, Artificial Sequence
  source: /note="Description of Artificial Sequence: Synthetic polypeptide"
LEPGEKPYKCPECGKSFSQSGHLTEHQRTHTGEKPYKCPECGKSFSRRDELNVHQRTHTGEKPYKCPECGKSFSQLAHLRAHQRTHTGEKPYKCPECGKSFSRSDKLVRHQRTHTGEKPYKCPECGKSFSQSGDLRRHQRTHTGEKPYKCPECGKSFSRSDNLVRHQRTHTGEKPYKCPECGKSFSRSDELVRHQRTHTGEKPTGKKTS

SEQ ID NO: 1677 - protein, 209 aa, Artificial Sequence
  source: /note="Description of Artificial Sequence: Synthetic polypeptide"
LEPGEKPYKCPECGKSFSRSDHLTNHQRTHTGEKPYKCPECGKSFSTSGHLVRHQRTHTGEKPYKCPECGKSFSRADNLTEHQRTHTGEKPYKCPECGKSFSDCRDLARHQRTHTGEKPYKCPECGKSFSDPGHLVRHQRTHTGEKPYKCPECGKSFSRSDELVRHQRTHTGEKPYKCPECGKSFSRSDKLVRHQRTHTGEKPTGKKTS

SEQ ID NO: 1678 - protein, 209 aa, Artificial Sequence
  source: /note="Description of Artificial Sequence: Synthetic polypeptide"
LEPGEKPYKCPECGKSFSQSGDLRRHQRTHTGEKPYKCPECGKSFSRSDHLTNHQRTHTGEKPYKCPECGKSFSTSGHLVRHQRTHTGEKPYKCPECGKSFSRADNLTEHQRTHTGEKPYKCPECGKSFSDCRDLARHQRTHTGEKPYKCPECGKSFSDPGHLVRHQRTHTGEKPYKCPECGKSFSRSDELVRHQRTHTGEKPTGKKTS

SEQ ID NO: 1679 - protein, 209 aa, Artificial Sequence
  source: /note="Description of Artificial Sequence: Synthetic polypeptide"
LEPGEKPYKCPECGKSFSRSDNLVRHQRTHTGEKPYKCPECGKSFSRSDELVRHQRTHTGEKPYKCPECGKSFSDPGHLVRHQRTHTGEKPYKCPECGKSFSHTGHLLEHQRTHTGEKPYKCPECGKSFSDPGHLVRHQRTHTGEKPYKCPECGKSFSTSGHLVRHQRTHTGEKPYKCPECGKSFSQSGDLRRHQRTHTGEKPTGKKTS

SEQ ID NO: 1680 - protein, 209 aa, Artificial Sequence
  source: /note="Description of Artificial Sequence: Synthetic polypeptide"
LEPGEKPYKCPECGKSFSQSGDLRRHQRTHTGEKPYKCPECGKSFSRSDNLVRHQRTHTGEKPYKCPECGKSFSRSDELVRHQRTHTGEKPYKCPECGKSFSDPGHLVRHQRTHTGEKPYKCPECGKSFSHTGHLLEHQRTHTGEKPYKCPECGKSFSDPGHLVRHQRTHTGEKPYKCPECGKSFSTSGHLVRHQRTHTGEKPTGKKTS

SEQ ID NO: 1681 - protein, 209 aa, Artificial Sequence
  source: /note="Description of Artificial Sequence: Synthetic polypeptide"
LEPGEKPYKCPECGKSFSRSDELVRHQRTHTGEKPYKCPECGKSFSDPGHLVRHQRTHTGEKPYKCPECGKSFSHTGHLLEHQRTHTGEKPYKCPECGKSFSDPGHLVRHQRTHTGEKPYKCPECGKSFSTSGHLVRHQRTHTGEKPYKCPECGKSFSQSGDLRRHQRTHTGEKPYKCPECGKSFSRSDHLTNHQRTHTGEKPTGKKTS

SEQ ID NO: 1682 - protein, 209 aa, Artificial Sequence
  source: /note="Description of Artificial Sequence: Synthetic polypeptide"
LEPGEKPYKCPECGKSFSDPGHLVRHQRTHTGEKPYKCPECGKSFSTSGHLVRHQRTHTGEKPYKCPECGKSFSQSGDLRRHQRTHTGEKPYKCPECGKSFSRSDHLTNHQRTHTGEKPYKCPECGKSFSTSGHLVRHQRTHTGEKPYKCPECGKSFSRADNLTEHQRTHTGEKPYKCPECGKSFSDCRDLARHQRTHTGEKPTGKKTS

SEQ ID NO: 1683 - protein, 209 aa, Artificial Sequence
  source: /note="Description of Artificial Sequence: Synthetic polypeptide"
LEPGEKPYKCPECGKSFSTSGHLVRHQRTHTGEKPYKCPECGKSFSQSGDLRRHQRTHTGEKPYKCPECGKSFSRSDHLTNHQRTHTGEKPYKCPECGKSFSTSGHLVRHQRTHTGEKPYKCPECGKSFSRADNLTEHQRTHTGEKPYKCPECGKSFSDCRDLARHQRTHTGEKPYKCPECGKSFSDPGHLVRHQRTHTGEKPTGKKTS

SEQ ID NO: 1684 - protein, 209 aa, Artificial Sequence
  source: /note="Description of Artificial Sequence: Synthetic polypeptide"
LEPGEKPYKCPECGKSFSHTGHLLEHQRTHTGEKPYKCPECGKSFSDPGHLVRHQRTHTGEKPYKCPECGKSFSTSGHLVRHQRTHTGEKPYKCPECGKSFSQSGDLRRHQRTHTGEKPYKCPECGKSFSRSDHLTNHQRTHTGEKPYKCPECGKSFSTSGHLVRHQRTHTGEKPYKCPECGKSFSRADNLTEHQRTHTGEKPTGKKTS

SEQ ID NO: 1685 - protein, 209 aa, Artificial Sequence
  source: /note="Description of Artificial Sequence: Synthetic polypeptide"
LEPGEKPYKCPECGKSFSDPGHLVRHQRTHTGEKPYKCPECGKSFSHTGHLLEHQRTHTGEKPYKCPECGKSFSDPGHLVRHQRTHTGEKPYKCPECGKSFSTSGHLVRHQRTHTGEKPYKCPECGKSFSQSGDLRRHQRTHTGEKPYKCPECGKSFSRSDHLTNHQRTHTGEKPYKCPECGKSFSTSGHLVRHQRTHTGEKPTGKKTS

SEQ ID NO: 1686 - protein, 209 aa, Artificial Sequence
  source: /note="Description of Artificial Sequence: Synthetic polypeptide"
LEPGEKPYKCPECGKSFSRSDDLVRHQRTHTGEKPYKCPECGKSFSDCRDLARHQRTHTGEKPYKCPECGKSFSRSDELVRHQRTHTGEKPYKCPECGKSFSRADNLTEHQRTHTGEKPYKCPECGKSFSRSDKLVRHQRTHTGEKPYKCPECGKSFSQSSSLVRHQRTHTGEKPYKCPECGKSFSRSDHLTNHQRTHTGEKPTGKKTS

SEQ ID NO: 1687 - protein, 209 aa, Artificial Sequence
  source: /note="Description of Artificial Sequence: Synthetic polypeptide"
LEPGEKPYKCPECGKSFSDCRDLARHQRTHTGEKPYKCPECGKSFSRSDELVRHQRTHTGEKPYKCPECGKSFSRADNLTEHQRTHTGEKPYKCPECGKSFSRSDKLVRHQRTHTGEKPYKCPECGKSFSQSSSLVRHQRTHTGEKPYKCPECGKSFSRSDHLTNHQRTHTGEKPYKCPECGKSFSSKKHLAEHQRTHTGEKPTGKKTS

SEQ ID NO: 1688 - protein, 209 aa, Artificial Sequence
  source: /note="Description of Artificial Sequence: Synthetic polypeptide"
LEPGEKPYKCPECGKSFSRSDDLVRHQRTHTGEKPYKCPECGKSFSRSDDLVRHQRTHTGEKPYKCPECGKSFSDCRDLARHQRTHTGEKPYKCPECGKSFSRSDELVRHQRTHTGEKPYKCPECGKSFSRADNLTEHQRTHTGEKPYKCPECGKSFSRSDKLVRHQRTHTGEKPYKCPECGKSFSQSSSLVRHQRTHTGEKPTGKKTS

SEQ ID NO: 1689 - protein, 209 aa, Artificial Sequence
  source: /note="Description of Artificial Sequence: Synthetic polypeptide"
LEPGEKPYKCPECGKSFSRSDHLTTHQRTHTGEKPYKCPECGKSFSRSDDLVRHQRTHTGEKPYKCPECGKSFSRSDDLVRHQRTHTGEKPYKCPECGKSFSDCRDLARHQRTHTGEKPYKCPECGKSFSRSDELVRHQRTHTGEKPYKCPECGKSFSRADNLTEHQRTHTGEKPYKCPECGKSFSRSDKLVRHQRTHTGEKPTGKKTS

SEQ ID NO: 1690 - protein, 209 aa, Artificial Sequence
  source: /note="Description of Artificial Sequence: Synthetic polypeptide"
LEPGEKPYKCPECGKSFSRADNLTEHQRTHTGEKPYKCPECGKSFSRSDHLTNHQRTHTGEKPYKCPECGKSFSRSDHLTTHQRTHTGEKPYKCPECGKSFSRSDDLVRHQRTHTGEKPYKCPECGKSFSRSDDLVRHQRTHTGEKPYKCPECGKSFSDCRDLARHQRTHTGEKPYKCPECGKSFSRSDELVRHQRTHTGEKPTGKKTS

SEQ ID NO: 1691 - protein, 209 aa, Artificial Sequence
  source: /note="Description of Artificial Sequence: Synthetic polypeptide"
LEPGEKPYKCPECGKSFSRSDHLTNHQRTHTGEKPYKCPECGKSFSRSDHLTTHQRTHTGEKPYKCPECGKSFSRSDDLVRHQRTHTGEKPYKCPECGKSFSRSDDLVRHQRTHTGEKPYKCPECGKSFSDCRDLARHQRTHTGEKPYKCPECGKSFSRSDELVRHQRTHTGEKPYKCPECGKSFSRADNLTEHQRTHTGEKPTGKKTS

SEQ ID NO: 1692 - protein, 209 aa, Artificial Sequence
  source: /note="Description of Artificial Sequence: Synthetic polypeptide"
LEPGEKPYKCPECGKSFSRSDELVRHQRTHTGEKPYKCPECGKSFSRADNLTEHQRTHTGEKPYKCPECGKSFSRSDKLVRHQRTHTGEKPYKCPECGKSFSQSSSLVRHQRTHTGEKPYKCPECGKSFSRSDHLTNHQRTHTGEKPYKCPECGKSFSSKKHLAEHQRTHTGEKPYKCPECGKSFSRSDDLVRHQRTHTGEKPTGKKTS

SEQ ID NO: 1693 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSQSSSLVRHQRTHTGEKPYKCPECGKSFSRSDHLTNHQRTHTGEKPYKCPECGKSFSSKKHLAEHQRTHTGEKPYKCPECGKSFSRSDDLVRHQRTHTGEKPYKCPECGKSFSRSDHLTTHQRTHTGEKPYKCPECGKSFSRSDKLVRHQRTHTGEKPTGKKTS

SEQ ID NO: 1694 - protein, 209 aa, Artificial Sequence
  source: /note="Description of Artificial Sequence: Synthetic polypeptide"
LEPGEKPYKCPECGKSFSRADNLTEHQRTHTGEKPYKCPECGKSFSRSDKLVRHQRTHTGEKPYKCPECGKSFSQSSSLVRHQRTHTGEKPYKCPECGKSFSRSDHLTNHQRTHTGEKPYKCPECGKSFSSKKHLAEHQRTHTGEKPYKCPECGKSFSRSDDLVRHQRTHTGEKPYKCPECGKSFSRSDHLTTHQRTHTGEKPTGKKTS

SEQ ID NO: 1695 - protein, 209 aa, Artificial Sequence
  source: /note="Description of Artificial Sequence: Synthetic polypeptide"
LEPGEKPYKCPECGKSFSQSSNLVRHQRTHTGEKPYKCPECGKSFSQRAHLERHQRTHTGEKPYKCPECGKSFSRADNLTEHQRTHTGEKPYKCPECGKSFSRSDHLTNHQRTHTGEKPYKCPECGKSFSRSDHLTTHQRTHTGEKPYKCPECGKSFSRSDDLVRHQRTHTGEKPYKCPECGKSFSRSDDLVRHQRTHTGEKPTGKKTS

SEQ ID NO: 1696 - protein, 209 aa, Artificial Sequence
  source: /note="Description of Artificial Sequence: Synthetic polypeptide"
LEPGEKPYKCPECGKSFSQRAHLERHQRTHTGEKPYKCPECGKSFSRADNLTEHQRTHTGEKPYKCPECGKSFSRSDHLTNHQRTHTGEKPYKCPECGKSFSRSDHLTTHQRTHTGEKPYKCPECGKSFSRSDDLVRHQRTHTGEKPYKCPECGKSFSRSDDLVRHQRTHTGEKPYKCPECGKSFSDCRDLARHQRTHTGEKPTGKKTS

SEQ ID NO: 1697 - protein, 209 aa, Artificial Sequence
  source: /note="Description of Artificial Sequence: Synthetic polypeptide"
LEPGEKPYKCPECGKSFSTSGNLTEHQRTHTGEKPYKCPECGKSFSQRAHLERHQRTHTGEKPYKCPECGKSFSTSGNLTEHQRTHTGEKPYKCPECGKSFSQSGHLTEHQRTHTGEKPYKCPECGKSFSSRRTCRAHQRTHTGEKPYKCPECGKSFSTKNSLTEHQRTHTGEKPYKCPECGKSFSDSGNLRVHQRTHTGEKPTGKKTS

SEQ ID NO: 1698 - protein, 209 aa, Artificial Sequence
  source: /note="Description of Artificial Sequence: Synthetic polypeptide"
LEPGEKPYKCPECGKSFSDPGHLVRHQRTHTGEKPYKCPECGKSFSTSGNLTEHQRTHTGEKPYKCPECGKSFSQRAHLERHQRTHTGEKPYKCPECGKSFSTSGNLTEHQRTHTGEKPYKCPECGKSFSQSGHLTEHQRTHTGEKPYKCPECGKSFSSRRTCRAHQRTHTGEKPYKCPECGKSFSTKNSLTEHQRTHTGEKPTGKKTS

SEQ ID NO: 1699 - protein, 209 aa, Artificial Sequence
  source: /note="Description of Artificial Sequence: Synthetic polypeptide"
LEPGEKPYKCPECGKSFSRADNLTEHQRTHTGEKPYKCPECGKSFSQNSTLTEHQRTHTGEKPYKCPECGKSFSQSGHLTEHQRTHTGEKPYKCPECGKSFSDPGHLVRHQRTHTGEKPYKCPECGKSFSTSGNLTEHQRTHTGEKPYKCPECGKSFSQRAHLERHQRTHTGEKPYKCPECGKSFSTSGNLTEHQRTHTGEKPTGKKTS

SEQ ID NO: 1700 - protein, 209 aa, Artificial Sequence
  source: /note="Description of Artificial Sequence: Synthetic polypeptide"
LEPGEKPYKCPECGKSFSQRAHLERHQRTHTGEKPYKCPECGKSFSTSGNLTEHQRTHTGEKPYKCPECGKSFSQSGHLTEHQRTHTGEKPYKCPECGKSFSSRRTCRAHQRTHTGEKPYKCPECGKSFSTKNSLTEHQRTHTGEKPYKCPECGKSFSDSGNLRVHQRTHTGEKPYKCPECGKSFSQSGNLTEHQRTHTGEKPTGKKTS

SEQ ID NO: 1701 - protein, 209 aa, Artificial Sequence
  source: /note="Description of Artificial Sequence: Synthetic polypeptide"
LEPGEKPYKCPECGKSFSQSGHLTEHQRTHTGEKPYKCPECGKSFSDPGHLVRHQRTHTGEKPYKCPECGKSFSTSGNLTEHQRTHTGEKPYKCPECGKSFSQRAHLERHQRTHTGEKPYKCPECGKSFSTSGNLTEHQRTHTGEKPYKCPECGKSFSQSGHLTEHQRTHTGEKPYKCPECGKSFSSRRTCRAHQRTHTGEKPTGKKTS

SEQ ID NO: 1702 - protein, 209 aa, Artificial Sequence
  source: /note="Description of Artificial Sequence: Synthetic polypeptide"
LEPGEKPYKCPECGKSFSQNSTLTEHQRTHTGEKPYKCPECGKSFSQSGHLTEHQRTHTGEKPYKCPECGKSFSDPGHLVRHQRTHTGEKPYKCPECGKSFSTSGNLTEHQRTHTGEKPYKCPECGKSFSQRAHLERHQRTHTGEKPYKCPECGKSFSTSGNLTEHQRTHTGEKPYKCPECGKSFSQSGHLTEHQRTHTGEKPTGKKTS

SEQ ID NO: 1703 - protein, 209 aa, Artificial Sequence
  source: /note="Description of Artificial Sequence: Synthetic polypeptide"
LEPGEKPYKCPECGKSFSDPGNLVRHQRTHTGEKPYKCPECGKSFSDCRDLARHQRTHTGEKPYKCPECGKSFSRRDELNVHQRTHTGEKPYKCPECGKSFSDPGNLVRHQRTHTGEKPYKCPECGKSFSRRDELNVHQRTHTGEKPYKCPECGKSFSDPGNLVRHQRTHTGEKPYKCPECGKSFSDPGALVRHQRTHTGEKPTGKKTS

SEQ ID NO: 1704 - protein, 209 aa, Artificial Sequence
  source: /note="Description of Artificial Sequence: Synthetic polypeptide"
LEPGEKPYKCPECGKSFSTKNSLTEHQRTHTGEKPYKCPECGKSFSRADNLTEHQRTHTGEKPYKCPECGKSFSDKKDLTRHQRTHTGEKPYKCPECGKSFSRSDHLTTHQRTHTGEKPYKCPECGKSFSSKKALTEHQRTHTGEKPYKCPECGKSFSRNDALTEHQRTHTGEKPYKCPECGKSFSRSDELVRHQRTHTGEKPTGKKTS

SEQ ID NO: 1705 - protein, 209 aa, Artificial Sequence
  source: /note="Description of Artificial Sequence: Synthetic polypeptide"
LEPGEKPYKCPECGKSFSRADNLTEHQRTHTGEKPYKCPECGKSFSDKKDLTRHQRTHTGEKPYKCPECGKSFSRSDHLTTHQRTHTGEKPYKCPECGKSFSSKKALTEHQRTHTGEKPYKCPECGKSFSRNDALTEHQRTHTGEKPYKCPECGKSFSRSDELVRHQRTHTGEKPYKCPECGKSFSSPADLTRHQRTHTGEKPTGKKTS

SEQ ID NO: 1706 - protein, 209 aa, Artificial Sequence
  source: /note="Description of Artificial Sequence: Synthetic polypeptide"
LEPGEKPYKCPECGKSFSSPADLTRHQRTHTGEKPYKCPECGKSFSTKNSLTEHQRTHTGEKPYKCPECGKSFSRADNLTEHQRTHTGEKPYKCPECGKSFSDKKDLTRHQRTHTGEKPYKCPECGKSFSRSDHLTTHQRTHTGEKPYKCPECGKSFSSKKALTEHQRTHTGEKPYKCPECGKSFSRNDALTEHQRTHTGEKPTGKKTS

SEQ ID NO: 1707 - protein, 209 aa, Artificial Sequence
  source: /note="Description of Artificial Sequence: Synthetic polypeptide"
LEPGEKPYKCPECGKSFSTSHSLTEHQRTHTGEKPYKCPECGKSFSSPADLTRHQRTHTGEKPYKCPECGKSFSTKNSLTEHQRTHTGEKPYKCPECGKSFSRADNLTEHQRTHTGEKPYKCPECGKSFSDKKDLTRHQRTHTGEKPYKCPECGKSFSRSDHLTTHQRTHTGEKPYKCPECGKSFSSKKALTEHQRTHTGEKPTGKKTS

SEQ ID NO: 1708 - protein, 209 aa, Artificial Sequence
  source: /note="Description of Artificial Sequence: Synthetic polypeptide"
LEPGEKPYKCPECGKSFSDKKDLTRHQRTHTGEKPYKCPECGKSFSRSDHLTTHQRTHTGEKPYKCPECGKSFSSKKALTEHQRTHTGEKPYKCPECGKSFSRNDALTEHQRTHTGEKPYKCPECGKSFSRSDELVRHQRTHTGEKPYKCPECGKSFSSPADLTRHQRTHTGEKPYKCPECGKSFSTHLDLIRHQRTHTGEKPTGKKTS

SEQ ID NO: 1709 - protein, 209 aa, Artificial Sequence
  source: /note="Description of Artificial Sequence: Synthetic polypeptide"
LEPGEKPYKCPECGKSFSRNDALTEHQRTHTGEKPYKCPECGKSFSRSDELVRHQRTHTGEKPYKCPECGKSFSSPADLTRHQRTHTGEKPYKCPECGKSFSTHLDLIRHQRTHTGEKPYKCPECGKSFSRNDTLTEHQRTHTGEKPYKCPECGKSFSRSDHLTTHQRTHTGEKPYKCPECGKSFSSPADLTRHQRTHTGEKPTGKKTS

SEQ ID NO: 1710 - protein, 209 aa, Artificial Sequence
  source: /note="Description of Artificial Sequence: Synthetic polypeptide"
LEPGEKPYKCPECGKSFSRSDELVRHQRTHTGEKPYKCPECGKSFSSPADLTRHQRTHTGEKPYKCPECGKSFSTHLDLIRHQRTHTGEKPYKCPECGKSFSRNDTLTEHQRTHTGEKPYKCPECGKSFSRSDHLTTHQRTHTGEKPYKCPECGKSFSSPADLTRHQRTHTGEKPYKCPECGKSFSRSDHLTTHQRTHTGEKPTGKKTS

SEQ ID NO: 1711 - protein, 209 aa, Artificial Sequence
  source: /note="Description of Artificial Sequence: Synthetic polypeptide"
LEPGEKPYKCPECGKSFSTTGNLTVHQRTHTGEKPYKCPECGKSFSRSDHLTTHQRTHTGEKPYKCPECGKSFSSKKHLAEHQRTHTGEKPYKCPECGKSFSTSHSLTEHQRTHTGEKPYKCPECGKSFSSPADLTRHQRTHTGEKPYKCPECGKSFSTKNSLTEHQRTHTGEKPYKCPECGKSFSRADNLTEHQRTHTGEKPTGKKTS

SEQ ID NO: 1712 - protein, 209 aa, Artificial Sequence
  source: /note="Description of Artificial Sequence: Synthetic polypeptide"
LEPGEKPYKCPECGKSFSSPADLTRHQRTHTGEKPYKCPECGKSFSTHLDLIRHQRTHTGEKPYKCPECGKSFSRNDTLTEHQRTHTGEKPYKCPECGKSFSRSDHLTTHQRTHTGEKPYKCPECGKSFSSPADLTRHQRTHTGEKPYKCPECGKSFSRSDHLTTHQRTHTGEKPYKCPECGKSFSSPADLTRHQRTHTGEKPTGKKTS

SEQ ID NO: 1713 - protein, 209 aa, Artificial Sequence
  source: /note="Description of Artificial Sequence: Synthetic polypeptide"
LEPGEKPYKCPECGKSFSSKKHLAEHQRTHTGEKPYKCPECGKSFSTSHSLTEHQRTHTGEKPYKCPECGKSFSSPADLTRHQRTHTGEKPYKCPECGKSFSTKNSLTEHQRTHTGEKPYKCPECGKSFSRADNLTEHQRTHTGEKPYKCPECGKSFSDKKDLTRHQRTHTGEKPYKCPECGKSFSRSDHLTTHQRTHTGEKPTGKKTS

SEQ ID NO: 1714 - protein, 209 aa, Artificial Sequence
  source: /note="Description of Artificial Sequence: Synthetic polypeptide"
LEPGEKPYKCPECGKSFSRSDHLTTHQRTHTGEKPYKCPECGKSFSSKKHLAEHQRTHTGEKPYKCPECGKSFSTSHSLTEHQRTHTGEKPYKCPECGKSFSSPADLTRHQRTHTGEKPYKCPECGKSFSTKNSLTEHQRTHTGEKPYKCPECGKSFSRADNLTEHQRTHTGEKPYKCPECGKSFSDKKDLTRHQRTHTGEKPTGKKTS

SEQ ID NO: 1715 - protein, 209 aa, Artificial Sequence
  source: /note="Description of Artificial Sequence: Synthetic polypeptide"
LEPGEKPYKCPECGKSFSRSDHLTTHQRTHTGEKPYKCPECGKSFSSKKALTEHQRTHTGEKPYKCPECGKSFSRNDALTEHQRTHTGEKPYKCPECGKSFSRSDELVRHQRTHTGEKPYKCPECGKSFSSPADLTRHQRTHTGEKPYKCPECGKSFSTHLDLIRHQRTHTGEKPYKCPECGKSFSRNDTLTEHQRTHTGEKPTGKKTS

SEQ ID NO: 1716 - protein, 209 aa, Artificial Sequence
  source: /note="Description of Artificial Sequence: Synthetic polypeptide"
LEPGEKPYKCPECGKSFSSKKALTEHQRTHTGEKPYKCPECGKSFSRNDALTEHQRTHTGEKPYKCPECGKSFSRSDELVRHQRTHTGEKPYKCPECGKSFSSPADLTRHQRTHTGEKPYKCPECGKSFSTHLDLIRHQRTHTGEKPYKCPECGKSFSRNDTLTEHQRTHTGEKPYKCPECGKSFSRSDHLTTHQRTHTGEKPTGKKTS

SEQ ID NO: 1717 - protein, 209 aa, Artificial Sequence
  source: /note="Description of Artificial Sequence: Synthetic polypeptide"
LEPGEKPYKCPECGKSFSDCRDLARHQRTHTGEKPYKCPECGKSFSTSHSLTEHQRTHTGEKPYKCPECGKSFSDPGNLVRHQRTHTGEKPYKCPECGKSFSRNDALTEHQRTHTGEKPYKCPECGKSFSQSGDLRRHQRTHTGEKPYKCPECGKSFSTSGELVRHQRTHTGEKPYKCPECGKSFSHRTTLTNHQRTHTGEKPTGKKTS

SEQ ID NO: 1718 - protein, 209 aa, Artificial Sequence
  source: /note="Description of Artificial Sequence: Synthetic polypeptide"
LEPGEKPYKCPECGKSFSQAGHLASHQRTHTGEKPYKCPECGKSFSHKNALQNHQRTHTGEKPYKCPECGKSFSQRAHLERHQRTHTGEKPYKCPECGKSFSTKNSLTEHQRTHTGEKPYKCPECGKSFSSKKALTEHQRTHTGEKPYKCPECGKSFSSKKALTEHQRTHTGEKPYKCPECGKSFSQNSTLTEHQRTHTGEKPTGKKTS

SEQ ID NO: 1719 - protein, 209 aa, Artificial Sequence
  source: /note="Description of Artificial Sequence: Synthetic polypeptide"
LEPGEKPYKCPECGKSFSHKNALQNHQRTHTGEKPYKCPECGKSFSQRAHLERHQRTHTGEKPYKCPECGKSFSTKNSLTEHQRTHTGEKPYKCPECGKSFSSKKALTEHQRTHTGEKPYKCPECGKSFSSKKALTEHQRTHTGEKPYKCPECGKSFSQNSTLTEHQRTHTGEKPYKCPECGKSFSERSHLREHQRTHTGEKPTGKKTS

SEQ ID NO: 1720 - protein, 209 aa, Artificial Sequence
  source: /note="Description of Artificial Sequence: Synthetic polypeptide"
LEPGEKPYKCPECGKSFSQSSNLVRHQRTHTGEKPYKCPECGKSFSQAGHLASHQRTHTGEKPYKCPECGKSFSHKNALQNHQRTHTGEKPYKCPECGKSFSQRAHLERHQRTHTGEKPYKCPECGKSFSTKNSLTEHQRTHTGEKPYKCPECGKSFSSKKALTEHQRTHTGEKPYKCPECGKSFSSKKALTEHQRTHTGEKPTGKKTS

SEQ ID NO: 1721 - protein, 209 aa, Artificial Sequence
  source: /note="Description of Artificial Sequence: Synthetic polypeptide"
LEPGEKPYKCPECGKSFSTKNSLTEHQRTHTGEKPYKCPECGKSFSSKKALTEHQRTHTGEKPYKCPECGKSFSSKKALTEHQRTHTGEKPYKCPECGKSFSQNSTLTEHQRTHTGEKPYKCPECGKSFSERSHLREHQRTHTGEKPYKCPECGKSFSSKKHLAEHQRTHTGEKPYKCPECGKSFSQRAHLERHQRTHTGEKPTGKKTS

SEQ ID NO: 1722 - protein, 209 aa, Artificial Sequence
  source: /note="Description of Artificial Sequence: Synthetic polypeptide"
LEPGEKPYKCPECGKSFSQRAHLERHQRTHTGEKPYKCPECGKSFSTKNSLTEHQRTHTGEKPYKCPECGKSFSSKKALTEHQRTHTGEKPYKCPECGKSFSSKKALTEHQRTHTGEKPYKCPECGKSFSQNSTLTEHQRTHTGEKPYKCPECGKSFSERSHLREHQRTHTGEKPYKCPECGKSFSSKKHLAEHQRTHTGEKPTGKKTS

SEQ ID NO: 1723 - protein, 209 aa, Artificial Sequence
  source: /note="Description of Artificial Sequence: Synthetic polypeptide"
LEPGEKPYKCPECGKSFSSKKALTEHQRTHTGEKPYKCPECGKSFSSKKALTEHQRTHTGEKPYKCPECGKSFSQNSTLTEHQRTHTGEKPYKCPECGKSFSERSHLREHQRTHTGEKPYKCPECGKSFSSKKHLAEHQRTHTGEKPYKCPECGKSFSQRAHLERHQRTHTGEKPYKCPECGKSFSTHLDLIRHQRTHTGEKPTGKKTS

SEQ ID NO: 1724 - protein, 209 aa, Artificial Sequence
  source: /note="Description of Artificial Sequence: Synthetic polypeptide"
LEPGEKPYKCPECGKSFSRSDELVRHQRTHTGEKPYKCPECGKSFSTSGNLVRHQRTHTGEKPYKCPECGKSFSQSGDLRRHQRTHTGEKPYKCPECGKSFSRSDKLVRHQRTHTGEKPYKCPECGKSFSRSDELVRHQRTHTGEKPYKCPECGKSFSREDNLHTHQRTHTGEKPYKCPECGKSFSRSDHLTTHQRTHTGEKPTGKKTS

SEQ ID NO: 1725 - protein, 209 aa, Artificial Sequence
  source: /note="Description of Artificial Sequence: Synthetic polypeptide"
LEPGEKPYKCPECGKSFSSKKHLAEHQRTHTGEKPYKCPECGKSFSRSDELVRHQRTHTGEKPYKCPECGKSFSTSGNLVRHQRTHTGEKPYKCPECGKSFSQSGDLRRHQRTHTGEKPYKCPECGKSFSRSDKLVRHQRTHTGEKPYKCPECGKSFSRSDELVRHQRTHTGEKPYKCPECGKSFSREDNLHTHQRTHTGEKPTGKKTS

SEQ ID NO: 1726 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSRSDELVRHQRTHTGEKPYKCPECGKSFSREDNLHTHQRTHTGEKPYKCPECGKSFSRSDHLTTHQRTHTGEKPYKCPECGKSFSQSGNLTEHQRTHTGEKPYKCPECGKSFSRSDKLVRHQRTHTGEKPYKCPECGKSFSTSGNLVRHQRTHTGEKPTGKKTS

SEQ ID NO: 1727 - protein, 209 aa, Artificial Sequence
  source: /note="Description of Artificial Sequence: Synthetic polypeptide"
LEPGEKPYKCPECGKSFSQSGDLRRHQRTHTGEKPYKCPECGKSFSRSDKLVRHQRTHTGEKPYKCPECGKSFSRSDELVRHQRTHTGEKPYKCPECGKSFSREDNLHTHQRTHTGEKPYKCPECGKSFSRSDHLTTHQRTHTGEKPYKCPECGKSFSQSGNLTEHQRTHTGEKPYKCPECGKSFSRSDKLVRHQRTHTGEKPTGKKTS

SEQ ID NO: 1728 - protein, 209 aa, Artificial Sequence
  source: /note="Description of Artificial Sequence: Synthetic polypeptide"
LEPGEKPYKCPECGKSFSTSGNLVRHQRTHTGEKPYKCPECGKSFSQSGDLRRHQRTHTGEKPYKCPECGKSFSRSDKLVRHQRTHTGEKPYKCPECGKSFSRSDELVRHQRTHTGEKPYKCPECGKSFSREDNLHTHQRTHTGEKPYKCPECGKSFSRSDHLTTHQRTHTGEKPYKCPECGKSFSQSGNLTEHQRTHTGEKPTGKKTS

SEQ ID NO: 1729 - protein, 209 aa, Artificial Sequence
  source: /note="Description of Artificial Sequence: Synthetic polypeptide"
LEPGEKPYKCPECGKSFSRSDHLTNHQRTHTGEKPYKCPECGKSFSSKKHLAEHQRTHTGEKPYKCPECGKSFSRSDELVRHQRTHTGEKPYKCPECGKSFSTSGNLVRHQRTHTGEKPYKCPECGKSFSQSGDLRRHQRTHTGEKPYKCPECGKSFSRSDKLVRHQRTHTGEKPYKCPECGKSFSRSDELVRHQRTHTGEKPTGKKTS

SEQ ID NO: 1730 - protein, 209 aa, Artificial Sequence
  source: /note="Description of Artificial Sequence: Synthetic polypeptide"
LEPGEKPYKCPECGKSFSRSDELVRHQRTHTGEKPYKCPECGKSFSREDNLHTHQRTHTGEKPYKCPECGKSFSRSDHLTTHQRTHTGEKPYKCPECGKSFSQSGNLTEHQRTHTGEKPYKCPECGKSFSRSDKLVRHQRTHTGEKPYKCPECGKSFSTSGNLVRHQRTHTGEKPYKCPECGKSFSDPGNLVRHQRTHTGEKPTGKKTS

SEQ ID NO: 1731 - protein, 209 aa, Artificial Sequence
  source: /note="Description of Artificial Sequence: Synthetic polypeptide"
LEPGEKPYKCPECGKSFSREDNLHTHQRTHTGEKPYKCPECGKSFSRSDHLTTHQRTHTGEKPYKCPECGKSFSQSGNLTEHQRTHTGEKPYKCPECGKSFSRSDKLVRHQRTHTGEKPYKCPECGKSFSTSGNLVRHQRTHTGEKPYKCPECGKSFSDPGNLVRHQRTHTGEKPYKCPECGKSFSTSGSLVRHQRTHTGEKPTGKKTS

SEQ ID NO: 1732 - protein, 209 aa, Artificial Sequence
  source: /note="Description of Artificial Sequence: Synthetic polypeptide"
LEPGEKPYKCPECGKSFSQSGNLTEHQRTHTGEKPYKCPECGKSFSRSDKLVRHQRTHTGEKPYKCPECGKSFSTSGNLVRHQRTHTGEKPYKCPECGKSFSDPGNLVRHQRTHTGEKPYKCPECGKSFSTSGSLVRHQRTHTGEKPYKCPECGKSFSTSGHLVRHQRTHTGEKPYKCPECGKSFSQSGDLRRHQRTHTGEKPTGKKTS

SEQ ID NO: 1733 - protein, 209 aa, Artificial Sequence
  source: /note="Description of Artificial Sequence: Synthetic polypeptide"
LEPGEKPYKCPECGKSFSRSDHLTTHQRTHTGEKPYKCPECGKSFSQSGNLTEHQRTHTGEKPYKCPECGKSFSRSDKLVRHQRTHTGEKPYKCPECGKSFSTSGNLVRHQRTHTGEKPYKCPECGKSFSDPGNLVRHQRTHTGEKPYKCPECGKSFSTSGSLVRHQRTHTGEKPYKCPECGKSFSTSGHLVRHQRTHTGEKPTGKKTS

SEQ ID NO: 1734 - protein, 209 aa, Artificial Sequence
  source: /note="Description of Artificial Sequence: Synthetic polypeptide"
LEPGEKPYKCPECGKSFSQLAHLRAHQRTHTGEKPYKCPECGKSFSDPGHLVRHQRTHTGEKPYKCPECGKSFSRSDKLVRHQRTHTGEKPYKCPECGKSFSTSGHLVRHQRTHTGEKPYKCPECGKSFSQSSSLVRHQRTHTGEKPYKCPECGKSFSRRDELNVHQRTHTGEKPYKCPECGKSFSQSGDLRRHQRTHTGEKPTGKKTS

SEQ ID NO: 1735 - protein, 209 aa, Artificial Sequence
  source: /note="Description of Artificial Sequence: Synthetic polypeptide"
LEPGEKPYKCPECGKSFSDPGHLVRHQRTHTGEKPYKCPECGKSFSRSDKLVRHQRTHTGEKPYKCPECGKSFSTSGHLVRHQRTHTGEKPYKCPECGKSFSQSSSLVRHQRTHTGEKPYKCPECGKSFSRRDELNVHQRTHTGEKPYKCPECGKSFSQSGDLRRHQRTHTGEKPYKCPECGKSFSRSDHLTTHQRTHTGEKPTGKKTS

SEQ ID NO: 1736 - protein, 209 aa, Artificial Sequence
  source: /note="Description of Artificial Sequence: Synthetic polypeptide"
LEPGEKPYKCPECGKSFSTSGHLVRHQRTHTGEKPYKCPECGKSFSQSSSLVRHQRTHTGEKPYKCPECGKSFSRRDELNVHQRTHTGEKPYKCPECGKSFSQSGDLRRHQRTHTGEKPYKCPECGKSFSRSDHLTTHQRTHTGEKPYKCPECGKSFSQSGHLTEHQRTHTGEKPYKCPECGKSFSQAGHLASHQRTHTGEKPTGKKTS

SEQ ID NO: 1737 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSTSGHLVRHQRTHTGEKPYKCPECGKSFSQSSSLVRHQRTHTGEKPYKCPECGKSFSRRDELNVHQRTHTGEKPYKCPECGKSFSQSGDLRRHQRTHTGEKPYKCPECGKSFSRSDHLTTHQRTHTGEKPYKCPECGKSFSQSGHLTEHQRTHTGEKPTGKKTS

SEQ ID NO: 1738 - protein, 209 aa, Artificial Sequence
  source: /note="Description of Artificial Sequence: Synthetic polypeptide"
LEPGEKPYKCPECGKSFSRADNLTEHQRTHTGEKPYKCPECGKSFSRSDKLVRHQRTHTGEKPYKCPECGKSFSRSDHLTTHQRTHTGEKPYKCPECGKSFSRSDHLTNHQRTHTGEKPYKCPECGKSFSTSGHLVRHQRTHTGEKPYKCPECGKSFSTTGNLTVHQRTHTGEKPYKCPECGKSFSDPGHLVRHQRTHTGEKPTGKKTS

SEQ ID NO: 1739 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSRSDHLTTHQRTHTGEKPYKCPECGKSFSRSDHLTNHQRTHTGEKPYKCPECGKSFSTSGHLVRHQRTHTGEKPYKCPECGKSFSTTGNLTVHQRTHTGEKPYKCPECGKSFSDPGHLVRHQRTHTGEKPYKCPECGKSFSRRDELNVHQRTHTGEKPTGKKTS

SEQ ID NO: 1740 - protein, 209 aa, Artificial Sequence
  source: /note="Description of Artificial Sequence: Synthetic polypeptide"
LEPGEKPYKCPECGKSFSRRDELNVHQRTHTGEKPYKCPECGKSFSRADNLTEHQRTHTGEKPYKCPECGKSFSRSDKLVRHQRTHTGEKPYKCPECGKSFSRSDHLTTHQRTHTGEKPYKCPECGKSFSRSDHLTNHQRTHTGEKPYKCPECGKSFSTSGHLVRHQRTHTGEKPYKCPECGKSFSTTGNLTVHQRTHTGEKPTGKKTS

SEQ ID NO: 1741 - protein, 209 aa, Artificial Sequence
  source: /note="Description of Artificial Sequence: Synthetic polypeptide"
LEPGEKPYKCPECGKSFSRSDHLTTHQRTHTGEKPYKCPECGKSFSRSDHLTNHQRTHTGEKPYKCPECGKSFSTSGHLVRHQRTHTGEKPYKCPECGKSFSTTGNLTVHQRTHTGEKPYKCPECGKSFSDPGHLVRHQRTHTGEKPYKCPECGKSFSRRDELNVHQRTHTGEKPYKCPECGKSFSRTDTLRDHQRTHTGEKPTGKKTS

SEQ ID NO: 1742 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSTKNSLTEHQRTHTGEKPYKCPECGKSFSRSDELVRHQRTHTGEKPYKCPECGKSFSTSGHLVRHQRTHTGEKPYKCPECGKSFSQSGDLRRHQRTHTGEKPYKCPECGKSFSRSDKLVRHQRTHTGEKPYKCPECGKSFSRSDELVRHQRTHTGEKPTGKKTS

SEQ ID NO: 1743 - protein, 209 aa, Artificial Sequence
  source: /note="Description of Artificial Sequence: Synthetic polypeptide"
LEPGEKPYKCPECGKSFSTKNSLTEHQRTHTGEKPYKCPECGKSFSRSDELVRHQRTHTGEKPYKCPECGKSFSTSGHLVRHQRTHTGEKPYKCPECGKSFSQSGDLRRHQRTHTGEKPYKCPECGKSFSRSDKLVRHQRTHTGEKPYKCPECGKSFSRSDELVRHQRTHTGEKPYKCPECGKSFSTSHSLTEHQRTHTGEKPTGKKTS

SEQ ID NO: 1744 - protein, 209 aa, Artificial Sequence
  source: /note="Description of Artificial Sequence: Synthetic polypeptide"
LEPGEKPYKCPECGKSFSRSDELVRHQRTHTGEKPYKCPECGKSFSTSGHLVRHQRTHTGEKPYKCPECGKSFSQSGDLRRHQRTHTGEKPYKCPECGKSFSRSDKLVRHQRTHTGEKPYKCPECGKSFSRSDELVRHQRTHTGEKPYKCPECGKSFSTSHSLTEHQRTHTGEKPYKCPECGKSFSRSDELVRHQRTHTGEKPTGKKTS

SEQ ID NO: 1745 - protein, 209 aa, Artificial Sequence
  source: /note="Description of Artificial Sequence: Synthetic polypeptide"
LEPGEKPYKCPECGKSFSQSGDLRRHQRTHTGEKPYKCPECGKSFSRSDKLVRHQRTHTGEKPYKCPECGKSFSRSDELVRHQRTHTGEKPYKCPECGKSFSTSHSLTEHQRTHTGEKPYKCPECGKSFSRSDELVRHQRTHTGEKPYKCPECGKSFSTSGHLVRHQRTHTGEKPYKCPECGKSFSTSHSLTEHQRTHTGEKPTGKKTS

SEQ ID NO: 1746 - protein, 209 aa, Artificial Sequence
  source: /note="Description of Artificial Sequence: Synthetic polypeptide"
LEPGEKPYKCPECGKSFSTSGHLVRHQRTHTGEKPYKCPECGKSFSQSGDLRRHQRTHTGEKPYKCPECGKSFSRSDKLVRHQRTHTGEKPYKCPECGKSFSRSDELVRHQRTHTGEKPYKCPECGKSFSTSHSLTEHQRTHTGEKPYKCPECGKSFSRSDELVRHQRTHTGEKPYKCPECGKSFSTSGHLVRHQRTHTGEKPTGKKTS

SEQ ID NO: 1747 - protein, 209 aa, Artificial Sequence
  source: /note="Description of Artificial Sequence: Synthetic polypeptide"
LEPGEKPYKCPECGKSFSSKKALTEHQRTHTGEKPYKCPECGKSFSRSDHLTTHQRTHTGEKPYKCPECGKSFSTTGALTEHQRTHTGEKPYKCPECGKSFSTSGNLVRHQRTHTGEKPYKCPECGKSFSQSGDLRRHQRTHTGEKPYKCPECGKSFSQRAHLERHQRTHTGEKPYKCPECGKSFSTSHSLTEHQRTHTGEKPTGKKTS

SEQ ID NO: 1748 - protein, 209 aa, Artificial Sequence
  source: /note="Description of Artificial Sequence: Synthetic polypeptide"
LEPGEKPYKCPECGKSFSTTGALTEHQRTHTGEKPYKCPECGKSFSTSGNLVRHQRTHTGEKPYKCPECGKSFSQSGDLRRHQRTHTGEKPYKCPECGKSFSQRAHLERHQRTHTGEKPYKCPECGKSFSTSHSLTEHQRTHTGEKPYKCPECGKSFSTSGHLVRHQRTHTGEKPYKCPECGKSFSRNDALTEHQRTHTGEKPTGKKTS

SEQ ID NO: 1749 - protein, 209 aa, Artificial Sequence
  source: /note="Description of Artificial Sequence: Synthetic polypeptide"
LEPGEKPYKCPECGKSFSRSDHLTTHQRTHTGEKPYKCPECGKSFSTTGALTEHQRTHTGEKPYKCPECGKSFSTSGNLVRHQRTHTGEKPYKCPECGKSFSQSGDLRRHQRTHTGEKPYKCPECGKSFSQRAHLERHQRTHTGEKPYKCPECGKSFSTSHSLTEHQRTHTGEKPYKCPECGKSFSTSGHLVRHQRTHTGEKPTGKKTS

SEQ ID NO: 1750 - protein, 209 aa, Artificial Sequence
  source: /note="Description of Artificial Sequence: Synthetic polypeptide"
LEPGEKPYKCPECGKSFSTTGNLTVHQRTHTGEKPYKCPECGKSFSQSGNLTEHQRTHTGEKPYKCPECGKSFSQKSSLIAHQRTHTGEKPYKCPECGKSFSRRDELNVHQRTHTGEKPYKCPECGKSFSQLAHLRAHQRTHTGEKPYKCPECGKSFSRSDHLTNHQRTHTGEKPYKCPECGKSFSRSDKLVRHQRTHTGEKPTGKKTS

SEQ ID NO: 1751 - protein, 209 aa, Artificial Sequence
  source: /note="Description of Artificial Sequence: Synthetic polypeptide"
LEPGEKPYKCPECGKSFSQKSSLIAHQRTHTGEKPYKCPECGKSFSRRDELNVHQRTHTGEKPYKCPECGKSFSQLAHLRAHQRTHTGEKPYKCPECGKSFSRSDHLTNHQRTHTGEKPYKCPECGKSFSRSDKLVRHQRTHTGEKPYKCPECGKSFSTSGHLVRHQRTHTGEKPYKCPECGKSFSRSDHLTTHQRTHTGEKPTGKKTS

SEQ ID NO: 1752 - protein, 209 aa, Artificial Sequence
  source: /note="Description of Artificial Sequence: Synthetic polypeptide"
LEPGEKPYKCPECGKSFSRRDELNVHQRTHTGEKPYKCPECGKSFSQLAHLRAHQRTHTGEKPYKCPECGKSFSRSDHLTNHQRTHTGEKPYKCPECGKSFSRSDKLVRHQRTHTGEKPYKCPECGKSFSTSGHLVRHQRTHTGEKPYKCPECGKSFSRSDHLTTHQRTHTGEKPYKCPECGKSFSTTGALTEHQRTHTGEKPTGKKTS

SEQ ID NO: 1753 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSTSGHLVRHQRTHTGEKPYKCPECGKSFSRSDHLTTHQRTHTGEKPYKCPECGKSFSTTGALTEHQRTHTGEKPYKCPECGKSFSQSGNLTEHQRTHTGEKPYKCPECGKSFSTHLDLIRHQRTHTGEKPYKCPECGKSFSDPGHLVRHQRTHTGEKPTGKKTS

SEQ ID NO: 1754 - protein, 209 aa, Artificial Sequence
  source: /note="Description of Artificial Sequence: Synthetic polypeptide"
LEPGEKPYKCPECGKSFSTSGHLVRHQRTHTGEKPYKCPECGKSFSTTGNLTVHQRTHTGEKPYKCPECGKSFSQSGNLTEHQRTHTGEKPYKCPECGKSFSQKSSLIAHQRTHTGEKPYKCPECGKSFSRRDELNVHQRTHTGEKPYKCPECGKSFSQLAHLRAHQRTHTGEKPYKCPECGKSFSRSDHLTNHQRTHTGEKPTGKKTS

SEQ ID NO: 1755 - protein, 209 aa, Artificial Sequence
  source: /note="Description of Artificial Sequence: Synthetic polypeptide"
LEPGEKPYKCPECGKSFSRSDHLTNHQRTHTGEKPYKCPECGKSFSTSGHLVRHQRTHTGEKPYKCPECGKSFSTTGNLTVHQRTHTGEKPYKCPECGKSFSQSGNLTEHQRTHTGEKPYKCPECGKSFSQKSSLIAHQRTHTGEKPYKCPECGKSFSRRDELNVHQRTHTGEKPYKCPECGKSFSQLAHLRAHQRTHTGEKPTGKKTS

SEQ ID NO: 1756 - protein, 209 aa, Artificial Sequence
  source: /note="Description of Artificial Sequence: Synthetic polypeptide"
LEPGEKPYKCPECGKSFSQSGNLTEHQRTHTGEKPYKCPECGKSFSQKSSLIAHQRTHTGEKPYKCPECGKSFSRRDELNVHQRTHTGEKPYKCPECGKSFSQLAHLRAHQRTHTGEKPYKCPECGKSFSRSDHLTNHQRTHTGEKPYKCPECGKSFSRSDKLVRHQRTHTGEKPYKCPECGKSFSTSGHLVRHQRTHTGEKPTGKKTS

SEQ ID NO: 1757 - protein, 209 aa, Artificial Sequence
  source: /note="Description of Artificial Sequence: Synthetic polypeptide"
LEPGEKPYKCPECGKSFSQLAHLRAHQRTHTGEKPYKCPECGKSFSRSDHLTNHQRTHTGEKPYKCPECGKSFSRSDKLVRHQRTHTGEKPYKCPECGKSFSTSGHLVRHQRTHTGEKPYKCPECGKSFSRSDHLTTHQRTHTGEKPYKCPECGKSFSTTGALTEHQRTHTGEKPYKCPECGKSFSQSGNLTEHQRTHTGEKPTGKKTS

SEQ ID NO: 1758 - protein, 209 aa, Artificial Sequence
  source: /note="Description of Artificial Sequence: Synthetic polypeptide"
LEPGEKPYKCPECGKSFSRSDHLTNHQRTHTGEKPYKCPECGKSFSRSDKLVRHQRTHTGEKPYKCPECGKSFSTSGHLVRHQRTHTGEKPYKCPECGKSFSRSDHLTTHQRTHTGEKPYKCPECGKSFSTTGALTEHQRTHTGEKPYKCPECGKSFSQSGNLTEHQRTHTGEKPYKCPECGKSFSTHLDLIRHQRTHTGEKPTGKKTS

SEQ ID NO: 1759 - protein, 209 aa, Artificial Sequence
  source: /note="Description of Artificial Sequence: Synthetic polypeptide"
LEPGEKPYKCPECGKSFSSPADLTRHQRTHTGEKPYKCPECGKSFSTSGNLVRHQRTHTGEKPYKCPECGKSFSTTGNLTVHQRTHTGEKPYKCPECGKSFSRSDNLVRHQRTHTGEKPYKCPECGKSFSRSDNLVRHQRTHTGEKPYKCPECGKSFSRSDHLTTHQRTHTGEKPYKCPECGKSFSRSDKLVRHQRTHTGEKPTGKKTS

SEQ ID NO: 1760 - protein, 209 aa, Artificial Sequence
  source: /note="Description of Artificial Sequence: Synthetic polypeptide"
LEPGEKPYKCPECGKSFSREDNLHTHQRTHTGEKPYKCPECGKSFSRSDHLTTHQRTHTGEKPYKCPECGKSFSQRANLRAHQRTHTGEKPYKCPECGKSFSSPADLTRHQRTHTGEKPYKCPECGKSFSTSGNLVRHQRTHTGEKPYKCPECGKSFSTTGNLTVHQRTHTGEKPYKCPECGKSFSRSDNLVRHQRTHTGEKPTGKKTS

SEQ ID NO: 1761 - protein, 209 aa, Artificial Sequence
  source: /note="Description of Artificial Sequence: Synthetic polypeptide"
LEPGEKPYKCPECGKSFSQRANLRAHQRTHTGEKPYKCPECGKSFSSPADLTRHQRTHTGEKPYKCPECGKSFSTSGNLVRHQRTHTGEKPYKCPECGKSFSTTGNLTVHQRTHTGEKPYKCPECGKSFSRSDNLVRHQRTHTGEKPYKCPECGKSFSRSDNLVRHQRTHTGEKPYKCPECGKSFSRSDHLTTHQRTHTGEKPTGKKTS

SEQ ID NO: 1762 - protein, 209 aa, Artificial Sequence
  source: /note="Description of Artificial Sequence: Synthetic polypeptide"
LEPGEKPYKCPECGKSFSRSDHLTTHQRTHTGEKPYKCPECGKSFSQRANLRAHQRTHTGEKPYKCPECGKSFSSPADLTRHQRTHTGEKPYKCPECGKSFSTSGNLVRHQRTHTGEKPYKCPECGKSFSTTGNLTVHQRTHTGEKPYKCPECGKSFSRSDNLVRHQRTHTGEKPYKCPECGKSFSRSDNLVRHQRTHTGEKPTGKKTS

SEQ ID NO: 1763 - protein, 209 aa, Artificial Sequence
  source: /note="Description of Artificial Sequence: Synthetic polypeptide"
LEPGEKPYKCPECGKSFSTSGSLVRHQRTHTGEKPYKCPECGKSFSREDNLHTHQRTHTGEKPYKCPECGKSFSRSDHLTTHQRTHTGEKPYKCPECGKSFSQRANLRAHQRTHTGEKPYKCPECGKSFSSPADLTRHQRTHTGEKPYKCPECGKSFSTSGNLVRHQRTHTGEKPYKCPECGKSFSTTGNLTVHQRTHTGEKPTGKKTS

SEQ ID NO: 1764 - protein, 209 aa, Artificial Sequence
  source: /note="Description of Artificial Sequence: Synthetic polypeptide"
LEPGEKPYKCPECGKSFSRSDHLTNHQRTHTGEKPYKCPECGKSFSSKKALTEHQRTHTGEKPYKCPECGKSFSRADNLTEHQRTHTGEKPYKCPECGKSFSDPGHLVRHQRTHTGEKPYKCPECGKSFSSPADLTRHQRTHTGEKPYKCPECGKSFSTKNSLTEHQRTHTGEKPYKCPECGKSFSTSGHLVRHQRTHTGEKPTGKKTS

SEQ ID NO: 1765 - protein, 209 aa, Artificial Sequence
  source: /note="Description of Artificial Sequence: Synthetic polypeptide"
LEPGEKPYKCPECGKSFSRADNLTEHQRTHTGEKPYKCPECGKSFSDPGHLVRHQRTHTGEKPYKCPECGKSFSSPADLTRHQRTHTGEKPYKCPECGKSFSTKNSLTEHQRTHTGEKPYKCPECGKSFSTSGHLVRHQRTHTGEKPYKCPECGKSFSTSGSLVRHQRTHTGEKPYKCPECGKSFSREDNLHTHQRTHTGEKPTGKKTS

SEQ ID NO: 1766 - protein, 209 aa, Artificial Sequence
  source: /note="Description of Artificial Sequence: Synthetic polypeptide"
LEPGEKPYKCPECGKSFSDPGHLVRHQRTHTGEKPYKCPECGKSFSSPADLTRHQRTHTGEKPYKCPECGKSFSTKNSLTEHQRTHTGEKPYKCPECGKSFSTSGHLVRHQRTHTGEKPYKCPECGKSFSTSGSLVRHQRTHTGEKPYKCPECGKSFSREDNLHTHQRTHTGEKPYKCPECGKSFSRSDHLTTHQRTHTGEKPTGKKTS

SEQ ID NO: 1767 - protein, 209 aa, Artificial Sequence
  source: /note="Description of Artificial Sequence: Synthetic polypeptide"
LEPGEKPYKCPECGKSFSSPADLTRHQRTHTGEKPYKCPECGKSFSTKNSLTEHQRTHTGEKPYKCPECGKSFSTSGHLVRHQRTHTGEKPYKCPECGKSFSTSGSLVRHQRTHTGEKPYKCPECGKSFSREDNLHTHQRTHTGEKPYKCPECGKSFSRSDHLTTHQRTHTGEKPYKCPECGKSFSQRANLRAHQRTHTGEKPTGKKTS

SEQ ID NO: 1768 - protein, 209 aa, Artificial Sequence
  source: /note="Description of Artificial Sequence: Synthetic polypeptide"
LEPGEKPYKCPECGKSFSTKNSLTEHQRTHTGEKPYKCPECGKSFSTSGHLVRHQRTHTGEKPYKCPECGKSFSTSGSLVRHQRTHTGEKPYKCPECGKSFSREDNLHTHQRTHTGEKPYKCPECGKSFSRSDHLTTHQRTHTGEKPYKCPECGKSFSQRANLRAHQRTHTGEKPYKCPECGKSFSSPADLTRHQRTHTGEKPTGKKTS

SEQ ID NO: 1769 - protein, 209 aa, Artificial Sequence
  source: /note="Description of Artificial Sequence: Synthetic polypeptide"
LEPGEKPYKCPECGKSFSTSGHLVRHQRTHTGEKPYKCPECGKSFSTSGSLVRHQRTHTGEKPYKCPECGKSFSREDNLHTHQRTHTGEKPYKCPECGKSFSRSDHLTTHQRTHTGEKPYKCPECGKSFSQRANLRAHQRTHTGEKPYKCPECGKSFSSPADLTRHQRTHTGEKPYKCPECGKSFSTSGNLVRHQRTHTGEKPTGKKTS

SEQ ID NO: 1770 - protein, 209 aa, Artificial Sequence
  source: /note="Description of Artificial Sequence: Synthetic polypeptide"
LEPGEKPYKCPECGKSFSSKKALTEHQRTHTGEKPYKCPECGKSFSRADNLTEHQRTHTGEKPYKCPECGKSFSDPGHLVRHQRTHTGEKPYKCPECGKSFSSPADLTRHQRTHTGEKPYKCPECGKSFSTKNSLTEHQRTHTGEKPYKCPECGKSFSTSGHLVRHQRTHTGEKPYKCPECGKSFSTSGSLVRHQRTHTGEKPTGKKTS

SEQ ID NO: 1771 - protein, 209 aa, Artificial Sequence
  source: /note="Description of Artificial Sequence: Synthetic polypeptide"
LEPGEKPYKCPECGKSFSTSGHLVRHQRTHTGEKPYKCPECGKSFSSPADLTRHQRTHTGEKPYKCPECGKSFSERSHLREHQRTHTGEKPYKCPECGKSFSDCRDLARHQRTHTGEKPYKCPECGKSFSRADNLTEHQRTHTGEKPYKCPECGKSFSQNSTLTEHQRTHTGEKPYKCPECGKSFSDPGALVRHQRTHTGEKPTGKKTS

SEQ ID NO: 1772 - protein, 209 aa, Artificial Sequence
  source: /note="Description of Artificial Sequence: Synthetic polypeptide"
LEPGEKPYKCPECGKSFSDCRDLARHQRTHTGEKPYKCPECGKSFSTSGSLVRHQRTHTGEKPYKCPECGKSFSTSGHLVRHQRTHTGEKPYKCPECGKSFSSPADLTRHQRTHTGEKPYKCPECGKSFSERSHLREHQRTHTGEKPYKCPECGKSFSDCRDLARHQRTHTGEKPYKCPECGKSFSRADNLTEHQRTHTGEKPTGKKTS

SEQ ID NO: 1773 - protein, 209 aa, Artificial Sequence
  source: /note="Description of Artificial Sequence: Synthetic polypeptide"
LEPGEKPYKCPECGKSFSTSGSLVRHQRTHTGEKPYKCPECGKSFSTSGHLVRHQRTHTGEKPYKCPECGKSFSSPADLTRHQRTHTGEKPYKCPECGKSFSERSHLREHQRTHTGEKPYKCPECGKSFSDCRDLARHQRTHTGEKPYKCPECGKSFSRADNLTEHQRTHTGEKPYKCPECGKSFSQNSTLTEHQRTHTGEKPTGKKTS

SEQ ID NO: 1774 - protein, 209 aa, Artificial Sequence
  source: /note="Description of Artificial Sequence: Synthetic polypeptide"
LEPGEKPYKCPECGKSFSTSHSLTEHQRTHTGEKPYKCPECGKSFSERSHLREHQRTHTGEKPYKCPECGKSFSQAGHLASHQRTHTGEKPYKCPECGKSFSRKDNLKNHQRTHTGEKPYKCPECGKSFSDCRDLARHQRTHTGEKPYKCPECGKSFSTSGSLVRHQRTHTGEKPYKCPECGKSFSTSGHLVRHQRTHTGEKPTGKKTS

SEQ ID NO: 1775 - protein, 209 aa, Artificial Sequence
  source: /note="Description of Artificial Sequence: Synthetic polypeptide"
LEPGEKPYKCPECGKSFSQAGHLASHQRTHTGEKPYKCPECGKSFSRKDNLKNHQRTHTGEKPYKCPECGKSFSDCRDLARHQRTHTGEKPYKCPECGKSFSTSGSLVRHQRTHTGEKPYKCPECGKSFSTSGHLVRHQRTHTGEKPYKCPECGKSFSSPADLTRHQRTHTGEKPYKCPECGKSFSERSHLREHQRTHTGEKPTGKKTS

SEQ ID NO: 1776 - protein, 209 aa, Artificial Sequence
  source: /note="Description of Artificial Sequence: Synthetic polypeptide"
LEPGEKPYKCPECGKSFSERSHLREHQRTHTGEKPYKCPECGKSFSQAGHLASHQRTHTGEKPYKCPECGKSFSRKDNLKNHQRTHTGEKPYKCPECGKSFSDCRDLARHQRTHTGEKPYKCPECGKSFSTSGSLVRHQRTHTGEKPYKCPECGKSFSTSGHLVRHQRTHTGEKPYKCPECGKSFSSPADLTRHQRTHTGEKPTGKKTS

SEQ ID NO: 1777 - protein, 209 aa, Artificial Sequence
  source: /note="Description of Artificial Sequence: Synthetic polypeptide"
LEPGEKPYKCPECGKSFSRKDNLKNHQRTHTGEKPYKCPECGKSFSDCRDLARHQRTHTGEKPYKCPECGKSFSTSGSLVRHQRTHTGEKPYKCPECGKSFSTSGHLVRHQRTHTGEKPYKCPECGKSFSSPADLTRHQRTHTGEKPYKCPECGKSFSERSHLREHQRTHTGEKPYKCPECGKSFSDCRDLARHQRTHTGEKPTGKKTS

SEQ ID NO: 1778 - protein, 209 aa, Artificial Sequence
  source: /note="Description of Artificial Sequence: Synthetic polypeptide"
LEPGEKPYKCPECGKSFSTSGNLTEHQRTHTGEKPYKCPECGKSFSRSDHLTNHQRTHTGEKPYKCPECGKSFSSKKALTEHQRTHTGEKPYKCPECGKSFSTSGNLVRHQRTHTGEKPYKCPECGKSFSHRTTLTNHQRTHTGEKPYKCPECGKSFSSKKALTEHQRTHTGEKPYKCPECGKSFSRSDHLTNHQRTHTGEKPTGKKTS

SEQ ID NO: 1779 - protein, 209 aa, Artificial Sequence
  source: /note="Description of Artificial Sequence: Synthetic polypeptide"
LEPGEKPYKCPECGKSFSSKKHLAEHQRTHTGEKPYKCPECGKSFSRSDELVRHQRTHTGEKPYKCPECGKSFSTSGNLTEHQRTHTGEKPYKCPECGKSFSDCRDLARHQRTHTGEKPYKCPECGKSFSQSSNLVRHQRTHTGEKPYKCPECGKSFSHRTTLTNHQRTHTGEKPYKCPECGKSFSTSHSLTEHQRTHTGEKPTGKKTS

SEQ ID NO: 1780 - protein, 209 aa, Artificial Sequence
  source: /note="Description of Artificial Sequence: Synthetic polypeptide"
LEPGEKPYKCPECGKSFSSKKALTEHQRTHTGEKPYKCPECGKSFSRSDHLTNHQRTHTGEKPYKCPECGKSFSSKKHLAEHQRTHTGEKPYKCPECGKSFSRSDELVRHQRTHTGEKPYKCPECGKSFSTSGNLTEHQRTHTGEKPYKCPECGKSFSDCRDLARHQRTHTGEKPYKCPECGKSFSQSSNLVRHQRTHTGEKPTGKKTS

SEQ ID NO: 1781 - protein, 209 aa, Artificial Sequence
  source: /note="Description of Artificial Sequence: Synthetic polypeptide"
LEPGEKPYKCPECGKSFSRSDHLTNHQRTHTGEKPYKCPECGKSFSSKKHLAEHQRTHTGEKPYKCPECGKSFSRSDELVRHQRTHTGEKPYKCPECGKSFSTSGNLTEHQRTHTGEKPYKCPECGKSFSDCRDLARHQRTHTGEKPYKCPECGKSFSQSSNLVRHQRTHTGEKPYKCPECGKSFSHRTTLTNHQRTHTGEKPTGKKTS

SEQ ID NO: 1782 - protein, 209 aa, Artificial Sequence
  source: /note="Description of Artificial Sequence: Synthetic polypeptide"
LEPGEKPYKCPECGKSFSSKKALTEHQRTHTGEKPYKCPECGKSFSTSGNLVRHQRTHTGEKPYKCPECGKSFSHRTTLTNHQRTHTGEKPYKCPECGKSFSSKKALTEHQRTHTGEKPYKCPECGKSFSRSDHLTNHQRTHTGEKPYKCPECGKSFSSKKHLAEHQRTHTGEKPYKCPECGKSFSRSDELVRHQRTHTGEKPTGKKTS

SEQ ID NO: 1783 - protein, 209 aa, Artificial Sequence
  source: /note="Description of Artificial Sequence: Synthetic polypeptide"
LEPGEKPYKCPECGKSFSHRTTLTNHQRTHTGEKPYKCPECGKSFSSKKALTEHQRTHTGEKPYKCPECGKSFSRSDHLTNHQRTHTGEKPYKCPECGKSFSSKKHLAEHQRTHTGEKPYKCPECGKSFSRSDELVRHQRTHTGEKPYKCPECGKSFSTSGNLTEHQRTHTGEKPYKCPECGKSFSDCRDLARHQRTHTGEKPTGKKTS

SEQ ID NO: 1784 - protein, 209 aa, Artificial Sequence
  source: /note="Description of Artificial Sequence: Synthetic polypeptide"
LEPGEKPYKCPECGKSFSTSGNLVRHQRTHTGEKPYKCPECGKSFSHRTTLTNHQRTHTGEKPYKCPECGKSFSSKKALTEHQRTHTGEKPYKCPECGKSFSRSDHLTNHQRTHTGEKPYKCPECGKSFSSKKHLAEHQRTHTGEKPYKCPECGKSFSRSDELVRHQRTHTGEKPYKCPECGKSFSTSGNLTEHQRTHTGEKPTGKKTS

SEQ ID NO: 1785 - protein, 209 aa, Artificial Sequence
  source: /note="Description of Artificial Sequence: Synthetic polypeptide"
LEPGEKPYKCPECGKSFSRSDHLTNHQRTHTGEKPYKCPECGKSFSSKKALTEHQRTHTGEKPYKCPECGKSFSTSGNLVRHQRTHTGEKPYKCPECGKSFSHRTTLTNHQRTHTGEKPYKCPECGKSFSSKKALTEHQRTHTGEKPYKCPECGKSFSRSDHLTNHQRTHTGEKPYKCPECGKSFSSKKHLAEHQRTHTGEKPTGKKTS

SEQ ID NO: 1786 - protein, 209 aa, Artificial Sequence
  source: /note="Description of Artificial Sequence: Synthetic polypeptide"
LEPGEKPYKCPECGKSFSTTGNLTVHQRTHTGEKPYKCPECGKSFSDCRDLARHQRTHTGEKPYKCPECGKSFSRSDHLTNHQRTHTGEKPYKCPECGKSFSQSGDLRRHQRTHTGEKPYKCPECGKSFSTKNSLTEHQRTHTGEKPYKCPECGKSFSRSDHLTNHQRTHTGEKPYKCPECGKSFSRSDKLVRHQRTHTGEKPTGKKTS

SEQ ID NO: 1787 - protein, 209 aa, Artificial Sequence
  source: /note="Description of Artificial Sequence: Synthetic polypeptide"
LEPGEKPYKCPECGKSFSDCRDLARHQRTHTGEKPYKCPECGKSFSRSDHLTNHQRTHTGEKPYKCPECGKSFSQSGDLRRHQRTHTGEKPYKCPECGKSFSTKNSLTEHQRTHTGEKPYKCPECGKSFSRSDHLTNHQRTHTGEKPYKCPECGKSFSRSDKLVRHQRTHTGEKPYKCPECGKSFSQSSNLVRHQRTHTGEKPTGKKTS

SEQ ID NO: 1788 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSQSSNLVRHQRTHTGEKPYKCPECGKSFSTSGHLVRHQRTHTGEKPYKCPECGKSFSRNDALTEHQRTHTGEKPYKCPECGKSFSHKNALQNHQRTHTGEKPYKCPECGKSFSDPGHLVRHQRTHTGEKPYKCPECGKSFSSPADLTRHQRTHTGEKPTGKKTS

SEQ ID NO: 1789 - protein, 209 aa, Artificial Sequence
  source: /note="Description of Artificial Sequence: Synthetic polypeptide"
LEPGEKPYKCPECGKSFSQSGDLRRHQRTHTGEKPYKCPECGKSFSTKNSLTEHQRTHTGEKPYKCPECGKSFSRSDHLTNHQRTHTGEKPYKCPECGKSFSRSDKLVRHQRTHTGEKPYKCPECGKSFSQSSNLVRHQRTHTGEKPYKCPECGKSFSTSGHLVRHQRTHTGEKPYKCPECGKSFSRNDALTEHQRTHTGEKPTGKKTS

SEQ ID NO: 1790 - protein, 209 aa, Artificial Sequence
  source: /note="Description of Artificial Sequence: Synthetic polypeptide"
LEPGEKPYKCPECGKSFSTKNSLTEHQRTHTGEKPYKCPECGKSFSRSDHLTNHQRTHTGEKPYKCPECGKSFSRSDKLVRHQRTHTGEKPYKCPECGKSFSQSSNLVRHQRTHTGEKPYKCPECGKSFSTSGHLVRHQRTHTGEKPYKCPECGKSFSRNDALTEHQRTHTGEKPYKCPECGKSFSHKNALQNHQRTHTGEKPTGKKTS

SEQ ID NO: 1791 - protein, 209 aa, Artificial Sequence
  source: /note="Description of Artificial Sequence: Synthetic polypeptide"
LEPGEKPYKCPECGKSFSRSDHLTNHQRTHTGEKPYKCPECGKSFSRSDKLVRHQRTHTGEKPYKCPECGKSFSQSSNLVRHQRTHTGEKPYKCPECGKSFSTSGHLVRHQRTHTGEKPYKCPECGKSFSRNDALTEHQRTHTGEKPYKCPECGKSFSHKNALQNHQRTHTGEKPYKCPECGKSFSDPGHLVRHQRTHTGEKPTGKKTS

SEQ ID NO: 1792 - protein, 209 aa, Artificial Sequence
  source: /note="Description of Artificial Sequence: Synthetic polypeptide"
LEPGEKPYKCPECGKSFSRSDHLTNHQRTHTGEKPYKCPECGKSFSQSGDLRRHQRTHTGEKPYKCPECGKSFSTKNSLTEHQRTHTGEKPYKCPECGKSFSRSDHLTNHQRTHTGEKPYKCPECGKSFSRSDKLVRHQRTHTGEKPYKCPECGKSFSQSSNLVRHQRTHTGEKPYKCPECGKSFSTSGHLVRHQRTHTGEKPTGKKTS

SEQ ID NO: 1793 - protein, 209 aa, Artificial Sequence
  source: /note="Description of Artificial Sequence: Synthetic polypeptide"
LEPGEKPYKCPECGKSFSHKNALQNHQRTHTGEKPYKCPECGKSFSTSHSLTEHQRTHTGEKPYKCPECGKSFSRSDKLVRHQRTHTGEKPYKCPECGKSFSQSGNLTEHQRTHTGEKPYKCPECGKSFSRNDALTEHQRTHTGEKPYKCPECGKSFSDPGHLVRHQRTHTGEKPYKCPECGKSFSQRAHLERHQRTHTGEKPTGKKTS

SEQ ID NO: 1794 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSQSGNLTEHQRTHTGEKPYKCPECGKSFSRNDALTEHQRTHTGEKPYKCPECGKSFSDPGHLVRHQRTHTGEKPYKCPECGKSFSQRAHLERHQRTHTGEKPYKCPECGKSFSRKDNLKNHQRTHTGEKPYKCPECGKSFSRSDELVRHQRTHTGEKPTGKKTS

SEQ ID NO: 1795 - protein, 209 aa, Artificial Sequence
  source: /note="Description of Artificial Sequence: Synthetic polypeptide"
LEPGEKPYKCPECGKSFSQSGNLTEHQRTHTGEKPYKCPECGKSFSRNDALTEHQRTHTGEKPYKCPECGKSFSDPGHLVRHQRTHTGEKPYKCPECGKSFSQRAHLERHQRTHTGEKPYKCPECGKSFSRKDNLKNHQRTHTGEKPYKCPECGKSFSRSDELVRHQRTHTGEKPYKCPECGKSFSRSDHLTTHQRTHTGEKPTGKKTS

SEQ ID NO: 1796 - protein, 209 aa, Artificial Sequence
  source: /note="Description of Artificial Sequence: Synthetic polypeptide"
LEPGEKPYKCPECGKSFSTSHSLTEHQRTHTGEKPYKCPECGKSFSRSDKLVRHQRTHTGEKPYKCPECGKSFSQSGNLTEHQRTHTGEKPYKCPECGKSFSRNDALTEHQRTHTGEKPYKCPECGKSFSDPGHLVRHQRTHTGEKPYKCPECGKSFSQRAHLERHQRTHTGEKPYKCPECGKSFSRKDNLKNHQRTHTGEKPTGKKTS

SEQ ID NO: 1797 - protein, 209 aa, Artificial Sequence
  source: /note="Description of Artificial Sequence: Synthetic polypeptide"
LEPGEKPYKCPECGKSFSDPGHLVRHQRTHTGEKPYKCPECGKSFSRRDELNVHQRTHTGEKPYKCPECGKSFSSKKALTEHQRTHTGEKPYKCPECGKSFSRSDKLVRHQRTHTGEKPYKCPECGKSFSTKNSLTEHQRTHTGEKPYKCPECGKSFSRSDELVRHQRTHTGEKPYKCPECGKSFSTHLDLIRHQRTHTGEKPTGKKTS

SEQ ID NO: 1798 - protein, 209 aa, Artificial Sequence
  source: /note="Description of Artificial Sequence: Synthetic polypeptide"
LEPGEKPYKCPECGKSFSSKKALTEHQRTHTGEKPYKCPECGKSFSTTGALTEHQRTHTGEKPYKCPECGKSFSRSDKLVRHQRTHTGEKPYKCPECGKSFSTSGNLTEHQRTHTGEKPYKCPECGKSFSQSGDLRRHQRTHTGEKPYKCPECGKSFSRSDHLTTHQRTHTGEKPYKCPECGKSFSDCRDLARHQRTHTGEKPTGKKTS

SEQ ID NO: 1799 - protein, 209 aa, Artificial Sequence
  source: /note="Description of Artificial Sequence: Synthetic polypeptide"
LEPGEKPYKCPECGKSFSTKNSLTEHQRTHTGEKPYKCPECGKSFSQSGNLTEHQRTHTGEKPYKCPECGKSFSDPGNLVRHQRTHTGEKPYKCPECGKSFSREDNLHTHQRTHTGEKPYKCPECGKSFSRNDALTEHQRTHTGEKPYKCPECGKSFSDPGHLVRHQRTHTGEKPYKCPECGKSFSTSGELVRHQRTHTGEKPTGKKTS

SEQ ID NO: 1800 - protein, 209 aa, Artificial Sequence
  source: /note="Description of Artificial Sequence: Synthetic polypeptide"
LEPGEKPYKCPECGKSFSDKKDLTRHQRTHTGEKPYKCPECGKSFSTKNSLTEHQRTHTGEKPYKCPECGKSFSQSGNLTEHQRTHTGEKPYKCPECGKSFSDPGNLVRHQRTHTGEKPYKCPECGKSFSREDNLHTHQRTHTGEKPYKCPECGKSFSRNDALTEHQRTHTGEKPYKCPECGKSFSDPGHLVRHQRTHTGEKPTGKKTS

SEQ ID NO: 1801 - protein, 209 aa, Artificial Sequence
  source: /note="Description of Artificial Sequence: Synthetic polypeptide"
LEPGEKPYKCPECGKSFSHKNALQNHQRTHTGEKPYKCPECGKSFSDKKDLTRHQRTHTGEKPYKCPECGKSFSTKNSLTEHQRTHTGEKPYKCPECGKSFSQSGNLTEHQRTHTGEKPYKCPECGKSFSDPGNLVRHQRTHTGEKPYKCPECGKSFSREDNLHTHQRTHTGEKPYKCPECGKSFSRNDALTEHQRTHTGEKPTGKKTS

SEQ ID NO: 1802 - protein, 209 aa, Artificial Sequence
  source: /note="Description of Artificial Sequence: Synthetic polypeptide"
LEPGEKPYKCPECGKSFSTSHSLTEHQRTHTGEKPYKCPECGKSFSRSDELVRHQRTHTGEKPYKCPECGKSFSQAGHLASHQRTHTGEKPYKCPECGKSFSHRTTLTNHQRTHTGEKPYKCPECGKSFSQSGNLTEHQRTHTGEKPYKCPECGKSFSSKKHLAEHQRTHTGEKPYKCPECGKSFSTSHSLTEHQRTHTGEKPTGKKTS

SEQ ID NO: 1803 - protein, 209 aa, Artificial Sequence
  source: /note="Description of Artificial Sequence: Synthetic polypeptide"
LEPGEKPYKCPECGKSFSRKDNLKNHQRTHTGEKPYKCPECGKSFSTSHSLTEHQRTHTGEKPYKCPECGKSFSRSDELVRHQRTHTGEKPYKCPECGKSFSQAGHLASHQRTHTGEKPYKCPECGKSFSHRTTLTNHQRTHTGEKPYKCPECGKSFSQSGNLTEHQRTHTGEKPYKCPECGKSFSSKKHLAEHQRTHTGEKPTGKKTS

SEQ ID NO: 1804 - protein, 209 aa, Artificial Sequence
  source: /note="Description of Artificial Sequence: Synthetic polypeptide"
LEPGEKPYKCPECGKSFSDKKDLTRHQRTHTGEKPYKCPECGKSFSSKKALTEHQRTHTGEKPYKCPECGKSFSRSDHLTNHQRTHTGEKPYKCPECGKSFSSKKHLAEHQRTHTGEKPYKCPECGKSFSQRAHLERHQRTHTGEKPYKCPECGKSFSTKNSLTEHQRTHTGEKPYKCPECGKSFSTSGELVRHQRTHTGEKPTGKKTS

SEQ ID NO: 1805 - protein, 209 aa, Artificial Sequence
  source: /note="Description of Artificial Sequence: Synthetic polypeptide"
LEPGEKPYKCPECGKSFSDCRDLARHQRTHTGEKPYKCPECGKSFSTKNSLTEHQRTHTGEKPYKCPECGKSFSSPADLTRHQRTHTGEKPYKCPECGKSFSDPGHLVRHQRTHTGEKPYKCPECGKSFSTSHSLTEHQRTHTGEKPYKCPECGKSFSDPGNLVRHQRTHTGEKPYKCPECGKSFSRNDALTEHQRTHTGEKPTGKKTS

SEQ ID NO: 1806 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSTKNSLTEHQRTHTGEKPYKCPECGKSFSSPADLTRHQRTHTGEKPYKCPECGKSFSDPGHLVRHQRTHTGEKPYKCPECGKSFSTHLDLIRHQRTHTGEKPYKCPECGKSFSSKKHLAEHQRTHTGEKPYKCPECGKSFSDCRDLARHQRTHTGEKPTGKKTS

SEQ ID NO: 1807 - protein, 209 aa, Artificial Sequence
  source: /note="Description of Artificial Sequence: Synthetic polypeptide"
LEPGEKPYKCPECGKSFSTKNSLTEHQRTHTGEKPYKCPECGKSFSSPADLTRHQRTHTGEKPYKCPECGKSFSDPGHLVRHQRTHTGEKPYKCPECGKSFSTHLDLIRHQRTHTGEKPYKCPECGKSFSSKKHLAEHQRTHTGEKPYKCPECGKSFSDCRDLARHQRTHTGEKPYKCPECGKSFSTKNSLTEHQRTHTGEKPTGKKTS

SEQ ID NO: 1808 - protein, 209 aa, Artificial Sequence
  source: /note="Description of Artificial Sequence: Synthetic polypeptide"
LEPGEKPYKCPECGKSFSDPGHLVRHQRTHTGEKPYKCPECGKSFSTHLDLIRHQRTHTGEKPYKCPECGKSFSSKKHLAEHQRTHTGEKPYKCPECGKSFSDCRDLARHQRTHTGEKPYKCPECGKSFSTKNSLTEHQRTHTGEKPYKCPECGKSFSSPADLTRHQRTHTGEKPYKCPECGKSFSDPGHLVRHQRTHTGEKPTGKKTS

SEQ ID NO: 1809 - protein, 209 aa, Artificial Sequence
  source: /note="Description of Artificial Sequence: Synthetic polypeptide"
LEPGEKPYKCPECGKSFSSPADLTRHQRTHTGEKPYKCPECGKSFSDPGHLVRHQRTHTGEKPYKCPECGKSFSTHLDLIRHQRTHTGEKPYKCPECGKSFSSKKHLAEHQRTHTGEKPYKCPECGKSFSDCRDLARHQRTHTGEKPYKCPECGKSFSTKNSLTEHQRTHTGEKPYKCPECGKSFSSPADLTRHQRTHTGEKPTGKKTS

SEQ ID NO: 1810 - protein, 209 aa, Artificial Sequence
  source: /note="Description of Artificial Sequence: Synthetic polypeptide"
LEPGEKPYKCPECGKSFSTHLDLIRHQRTHTGEKPYKCPECGKSFSSKKHLAEHQRTHTGEKPYKCPECGKSFSDCRDLARHQRTHTGEKPYKCPECGKSFSTKNSLTEHQRTHTGEKPYKCPECGKSFSSPADLTRHQRTHTGEKPYKCPECGKSFSDPGHLVRHQRTHTGEKPYKCPECGKSFSTSHSLTEHQRTHTGEKPTGKKTS

SEQ ID NO: 1811 - protein, 209 aa, Artificial Sequence
  source: /note="Description of Artificial Sequence: Synthetic polypeptide"
LEPGEKPYKCPECGKSFSSKKALTEHQRTHTGEKPYKCPECGKSFSRSDKLVRHQRTHTGEKPYKCPECGKSFSTKNSLTEHQRTHTGEKPYKCPECGKSFSSPADLTRHQRTHTGEKPYKCPECGKSFSDPGHLVRHQRTHTGEKPYKCPECGKSFSTHLDLIRHQRTHTGEKPYKCPECGKSFSSKKHLAEHQRTHTGEKPTGKKTS

SEQ ID NO: 1812 - protein, 209 aa, Artificial Sequence
  source: /note="Description of Artificial Sequence: Synthetic polypeptide"
LEPGEKPYKCPECGKSFSSKKHLAEHQRTHTGEKPYKCPECGKSFSDCRDLARHQRTHTGEKPYKCPECGKSFSTKNSLTEHQRTHTGEKPYKCPECGKSFSSPADLTRHQRTHTGEKPYKCPECGKSFSDPGHLVRHQRTHTGEKPYKCPECGKSFSTSHSLTEHQRTHTGEKPYKCPECGKSFSDPGNLVRHQRTHTGEKPTGKKTS

SEQ ID NO: 1813 - protein, 209 aa, Artificial Sequence
  source: /note="Description of Artificial Sequence: Synthetic polypeptide"
LEPGEKPYKCPECGKSFSSPADLTRHQRTHTGEKPYKCPECGKSFSDPGHLVRHQRTHTGEKPYKCPECGKSFSRNDALTEHQRTHTGEKPYKCPECGKSFSSKKALTEHQRTHTGEKPYKCPECGKSFSQSGDLRRHQRTHTGEKPYKCPECGKSFSRNDALTEHQRTHTGEKPYKCPECGKSFSTSHSLTEHQRTHTGEKPTGKKTS

SEQ ID NO: 1814 - protein, 209 aa, Artificial Sequence
  source: /note="Description of Artificial Sequence: Synthetic polypeptide"
LEPGEKPYKCPECGKSFSQSGDLRRHQRTHTGEKPYKCPECGKSFSRNDALTEHQRTHTGEKPYKCPECGKSFSTSHSLTEHQRTHTGEKPYKCPECGKSFSSKKHLAEHQRTHTGEKPYKCPECGKSFSRNDALTEHQRTHTGEKPYKCPECGKSFSSKKALTEHQRTHTGEKPYKCPECGKSFSQSGDLRRHQRTHTGEKPTGKKTS

SEQ ID NO: 1815 - protein, 209 aa, Artificial Sequence
  source: /note="Description of Artificial Sequence: Synthetic polypeptide"
LEPGEKPYKCPECGKSFSRNDALTEHQRTHTGEKPYKCPECGKSFSSKKALTEHQRTHTGEKPYKCPECGKSFSQSGDLRRHQRTHTGEKPYKCPECGKSFSRNDALTEHQRTHTGEKPYKCPECGKSFSTSHSLTEHQRTHTGEKPYKCPECGKSFSSKKHLAEHQRTHTGEKPYKCPECGKSFSRNDALTEHQRTHTGEKPTGKKTS

SEQ ID NO: 1816 - protein, 209 aa, Artificial Sequence
  source: /note="Description of Artificial Sequence: Synthetic polypeptide"
LEPGEKPYKCPECGKSFSDPGHLVRHQRTHTGEKPYKCPECGKSFSRNDALTEHQRTHTGEKPYKCPECGKSFSSKKALTEHQRTHTGEKPYKCPECGKSFSQSGDLRRHQRTHTGEKPYKCPECGKSFSRNDALTEHQRTHTGEKPYKCPECGKSFSTSHSLTEHQRTHTGEKPYKCPECGKSFSSKKHLAEHQRTHTGEKPTGKKTS

SEQ ID NO: 1817 - protein, 209 aa, Artificial Sequence
  source: /note="Description of Artificial Sequence: Synthetic polypeptide"
LEPGEKPYKCPECGKSFSRNDALTEHQRTHTGEKPYKCPECGKSFSTSHSLTEHQRTHTGEKPYKCPECGKSFSSKKHLAEHQRTHTGEKPYKCPECGKSFSRNDALTEHQRTHTGEKPYKCPECGKSFSSKKALTEHQRTHTGEKPYKCPECGKSFSQSGDLRRHQRTHTGEKPYKCPECGKSFSRADNLTEHQRTHTGEKPTGKKTS

SEQ ID NO: 1818 - protein, 209 aa, Artificial Sequence
  source: /note="Description of Artificial Sequence: Synthetic polypeptide"
LEPGEKPYKCPECGKSFSSKKHLAEHQRTHTGEKPYKCPECGKSFSRNDALTEHQRTHTGEKPYKCPECGKSFSSKKALTEHQRTHTGEKPYKCPECGKSFSQSGDLRRHQRTHTGEKPYKCPECGKSFSRADNLTEHQRTHTGEKPYKCPECGKSFSDKKDLTRHQRTHTGEKPYKCPECGKSFSRSDHLTTHQRTHTGEKPTGKKTS

SEQ ID NO: 1819 - protein, 209 aa, Artificial Sequence
  source: /note="Description of Artificial Sequence: Synthetic polypeptide"
LEPGEKPYKCPECGKSFSTSHSLTEHQRTHTGEKPYKCPECGKSFSSKKHLAEHQRTHTGEKPYKCPECGKSFSRNDALTEHQRTHTGEKPYKCPECGKSFSSKKALTEHQRTHTGEKPYKCPECGKSFSQSGDLRRHQRTHTGEKPYKCPECGKSFSRADNLTEHQRTHTGEKPYKCPECGKSFSDKKDLTRHQRTHTGEKPTGKKTS

SEQ ID NO: 1820 - protein, 209 aa, Artificial Sequence
  source: /note="Description of Artificial Sequence: Synthetic polypeptide"
LEPGEKPYKCPECGKSFSSKKALTEHQRTHTGEKPYKCPECGKSFSQSGDLRRHQRTHTGEKPYKCPECGKSFSRNDALTEHQRTHTGEKPYKCPECGKSFSTSHSLTEHQRTHTGEKPYKCPECGKSFSSKKHLAEHQRTHTGEKPYKCPECGKSFSRNDALTEHQRTHTGEKPYKCPECGKSFSSKKALTEHQRTHTGEKPTGKKTS

SEQ ID NO: 1821 - protein, 209 aa, Artificial Sequence
  source: /note="Description of Artificial Sequence: Synthetic polypeptide"
LEPGEKPYKCPECGKSFSSRRTCRAHQRTHTGEKPYKCPECGKSFSTSGNLTEHQRTHTGEKPYKCPECGKSFSDCRDLARHQRTHTGEKPYKCPECGKSFSHKNALQNHQRTHTGEKPYKCPECGKSFSDKKDLTRHQRTHTGEKPYKCPECGKSFSTKNSLTEHQRTHTGEKPYKCPECGKSFSTSHSLTEHQRTHTGEKPTGKKTS

SEQ ID NO: 1822 - protein, 209 aa, Artificial Sequence
  source: /note="Description of Artificial Sequence: Synthetic polypeptide"
LEPGEKPYKCPECGKSFSRNDALTEHQRTHTGEKPYKCPECGKSFSTSGNLTEHQRTHTGEKPYKCPECGKSFSQSGDLRRHQRTHTGEKPYKCPECGKSFSRSDHLTTHQRTHTGEKPYKCPECGKSFSDKKDLTRHQRTHTGEKPYKCPECGKSFSSKKALTEHQRTHTGEKPYKCPECGKSFSRSDHLTTHQRTHTGEKPTGKKTS

SEQ ID NO: 1823 - protein, 209 aa, Artificial Sequence
  source: /note="Description of Artificial Sequence: Synthetic polypeptide"
LEPGEKPYKCPECGKSFSTSGNLTEHQRTHTGEKPYKCPECGKSFSQSGDLRRHQRTHTGEKPYKCPECGKSFSRSDHLTTHQRTHTGEKPYKCPECGKSFSDKKDLTRHQRTHTGEKPYKCPECGKSFSSKKALTEHQRTHTGEKPYKCPECGKSFSRSDHLTTHQRTHTGEKPYKCPECGKSFSSKKALTEHQRTHTGEKPTGKKTS

SEQ ID NO: 1824 - protein, 209 aa, Artificial Sequence
  source: /note="Description of Artificial Sequence: Synthetic polypeptide"
LEPGEKPYKCPECGKSFSDCRDLARHQRTHTGEKPYKCPECGKSFSHKNALQNHQRTHTGEKPYKCPECGKSFSDKKDLTRHQRTHTGEKPYKCPECGKSFSTKNSLTEHQRTHTGEKPYKCPECGKSFSTSHSLTEHQRTHTGEKPYKCPECGKSFSSKKHLAEHQRTHTGEKPYKCPECGKSFSRNDALTEHQRTHTGEKPTGKKTS

SEQ ID NO: 1825 - protein, 209 aa, Artificial Sequence
  source: /note="Description of Artificial Sequence: Synthetic polypeptide"
LEPGEKPYKCPECGKSFSTKNSLTEHQRTHTGEKPYKCPECGKSFSTSHSLTEHQRTHTGEKPYKCPECGKSFSSKKHLAEHQRTHTGEKPYKCPECGKSFSRNDALTEHQRTHTGEKPYKCPECGKSFSTSGNLTEHQRTHTGEKPYKCPECGKSFSQSGDLRRHQRTHTGEKPYKCPECGKSFSRSDHLTTHQRTHTGEKPTGKKTS

SEQ ID NO: 1826 - protein, 209 aa, Artificial Sequence
  source: /note="Description of Artificial Sequence: Synthetic polypeptide"
LEPGEKPYKCPECGKSFSTSHSLTEHQRTHTGEKPYKCPECGKSFSSKKHLAEHQRTHTGEKPYKCPECGKSFSRNDALTEHQRTHTGEKPYKCPECGKSFSTSGNLTEHQRTHTGEKPYKCPECGKSFSQSGDLRRHQRTHTGEKPYKCPECGKSFSRSDHLTTHQRTHTGEKPYKCPECGKSFSDKKDLTRHQRTHTGEKPTGKKTS

SEQ ID NO: 1827 - protein, 209 aa, Artificial Sequence
  source: /note="Description of Artificial Sequence: Synthetic polypeptide"
LEPGEKPYKCPECGKSFSDKKDLTRHQRTHTGEKPYKCPECGKSFSTKNSLTEHQRTHTGEKPYKCPECGKSFSTSHSLTEHQRTHTGEKPYKCPECGKSFSSKKHLAEHQRTHTGEKPYKCPECGKSFSRNDALTEHQRTHTGEKPYKCPECGKSFSTSGNLTEHQRTHTGEKPYKCPECGKSFSQSGDLRRHQRTHTGEKPTGKKTS

SEQ ID NO: 1828 - protein, 209 aa, Artificial Sequence
  source: /note="Description of Artificial Sequence: Synthetic polypeptide"
LEPGEKPYKCPECGKSFSQSGNLTEHQRTHTGEKPYKCPECGKSFSSRRTCRAHQRTHTGEKPYKCPECGKSFSTSGNLTEHQRTHTGEKPYKCPECGKSFSDCRDLARHQRTHTGEKPYKCPECGKSFSHKNALQNHQRTHTGEKPYKCPECGKSFSDKKDLTRHQRTHTGEKPYKCPECGKSFSTKNSLTEHQRTHTGEKPTGKKTS

SEQ ID NO: 1829 - protein, 209 aa, Artificial Sequence
  source: /note="Description of Artificial Sequence: Synthetic polypeptide"
LEPGEKPYKCPECGKSFSHKNALQNHQRTHTGEKPYKCPECGKSFSDKKDLTRHQRTHTGEKPYKCPECGKSFSTKNSLTEHQRTHTGEKPYKCPECGKSFSTSHSLTEHQRTHTGEKPYKCPECGKSFSSKKHLAEHQRTHTGEKPYKCPECGKSFSRNDALTEHQRTHTGEKPYKCPECGKSFSTSGNLTEHQRTHTGEKPTGKKTS

SEQ ID NO: 1830 - protein, 209 aa, Artificial Sequence
  source: /note="Description of Artificial Sequence: Synthetic polypeptide"
LEPGEKPYKCPECGKSFSQSGDLRRHQRTHTGEKPYKCPECGKSFSRSDHLTTHQRTHTGEKPYKCPECGKSFSDKKDLTRHQRTHTGEKPYKCPECGKSFSSKKALTEHQRTHTGEKPYKCPECGKSFSRSDHLTTHQRTHTGEKPYKCPECGKSFSSKKALTEHQRTHTGEKPYKCPECGKSFSSKKHLAEHQRTHTGEKPTGKKTS

SEQ ID NO: 1831 - protein, 209 aa, Artificial Sequence
  source: /note="Description of Artificial Sequence: Synthetic polypeptide"
LEPGEKPYKCPECGKSFSTSGNLTEHQRTHTGEKPYKCPECGKSFSDCRDLARHQRTHTGEKPYKCPECGKSFSHKNALQNHQRTHTGEKPYKCPECGKSFSDKKDLTRHQRTHTGEKPYKCPECGKSFSTKNSLTEHQRTHTGEKPYKCPECGKSFSTSHSLTEHQRTHTGEKPYKCPECGKSFSSKKHLAEHQRTHTGEKPTGKKTS

SEQ ID NO: 1832 - protein, 209 aa, Artificial Sequence
  source: /note="Description of Artificial Sequence: Synthetic polypeptide"
LEPGEKPYKCPECGKSFSSKKHLAEHQRTHTGEKPYKCPECGKSFSRNDALTEHQRTHTGEKPYKCPECGKSFSTSGNLTEHQRTHTGEKPYKCPECGKSFSQSGDLRRHQRTHTGEKPYKCPECGKSFSRSDHLTTHQRTHTGEKPYKCPECGKSFSDKKDLTRHQRTHTGEKPYKCPECGKSFSSKKALTEHQRTHTGEKPTGKKTS

SEQ ID NO: 1833 - protein, 209 aa, Artificial Sequence
  source: /note="Description of Artificial Sequence: Synthetic polypeptide"
LEPGEKPYKCPECGKSFSRNDALTEHQRTHTGEKPYKCPECGKSFSSKKALTEHQRTHTGEKPYKCPECGKSFSQSGNLTEHQRTHTGEKPYKCPECGKSFSSRRTCRAHQRTHTGEKPYKCPECGKSFSTSGNLTEHQRTHTGEKPYKCPECGKSFSDCRDLARHQRTHTGEKPYKCPECGKSFSHKNALQNHQRTHTGEKPTGKKTS

SEQ ID NO: 1834 - protein, 209 aa, Artificial Sequence
  source: /note="Description of Artificial Sequence: Synthetic polypeptide"
LEPGEKPYKCPECGKSFSHKNALQNHQRTHTGEKPYKCPECGKSFSSKKALTEHQRTHTGEKPYKCPECGKSFSRNDALTEHQRTHTGEKPYKCPECGKSFSSKKALTEHQRTHTGEKPYKCPECGKSFSQSGNLTEHQRTHTGEKPYKCPECGKSFSSRRTCRAHQRTHTGEKPYKCPECGKSFSTSGNLTEHQRTHTGEKPTGKKTS

SEQ ID NO: 1835 - protein, 209 aa, Artificial Sequence
  source: /note="Description of Artificial Sequence: Synthetic polypeptide"
LEPGEKPYKCPECGKSFSSKKALTEHQRTHTGEKPYKCPECGKSFSQSGNLTEHQRTHTGEKPYKCPECGKSFSSRRTCRAHQRTHTGEKPYKCPECGKSFSTSGNLTEHQRTHTGEKPYKCPECGKSFSDCRDLARHQRTHTGEKPYKCPECGKSFSHKNALQNHQRTHTGEKPYKCPECGKSFSDKKDLTRHQRTHTGEKPTGKKTS

SEQ ID NO: 1836 - protein, 209 aa, Artificial Sequence
  source: /note="Description of Artificial Sequence: Synthetic polypeptide"
LEPGEKPYKCPECGKSFSSKKALTEHQRTHTGEKPYKCPECGKSFSRNDALTEHQRTHTGEKPYKCPECGKSFSSKKALTEHQRTHTGEKPYKCPECGKSFSQSGNLTEHQRTHTGEKPYKCPECGKSFSSRRTCRAHQRTHTGEKPYKCPECGKSFSTSGNLTEHQRTHTGEKPYKCPECGKSFSDCRDLARHQRTHTGEKPTGKKTS

SEQ ID NO: 1837 - protein, 209 aa, Artificial Sequence
  source: /note="Description of Artificial Sequence: Synthetic polypeptide"
LEPGEKPYKCPECGKSFSDPGALVRHQRTHTGEKPYKCPECGKSFSRSDHLTTHQRTHTGEKPYKCPECGKSFSDPGHLVRHQRTHTGEKPYKCPECGKSFSQSSSLVRHQRTHTGEKPYKCPECGKSFSTSGHLVRHQRTHTGEKPYKCPECGKSFSTSGHLVRHQRTHTGEKPYKCPECGKSFSRADNLTEHQRTHTGEKPTGKKTS

SEQ ID NO: 1838 - protein, 209 aa, Artificial Sequence
  source: /note="Description of Artificial Sequence: Synthetic polypeptide"
LEPGEKPYKCPECGKSFSRADNLTEHQRTHTGEKPYKCPECGKSFSDPGALVRHQRTHTGEKPYKCPECGKSFSRSDHLTTHQRTHTGEKPYKCPECGKSFSDPGHLVRHQRTHTGEKPYKCPECGKSFSQSSSLVRHQRTHTGEKPYKCPECGKSFSTSGHLVRHQRTHTGEKPYKCPECGKSFSTSGHLVRHQRTHTGEKPTGKKTS

SEQ ID NO: 1839 - protein, 209 aa, Artificial Sequence
  source: /note="Description of Artificial Sequence: Synthetic polypeptide"
LEPGEKPYKCPECGKSFSSKKALTEHQRTHTGEKPYKCPECGKSFSRADNLTEHQRTHTGEKPYKCPECGKSFSRSDELVRHQRTHTGEKPYKCPECGKSFSTSHSLTEHQRTHTGEKPYKCPECGKSFSTSGHLVRHQRTHTGEKPYKCPECGKSFSRNDALTEHQRTHTGEKPYKCPECGKSFSRSDHLTNHQRTHTGEKPTGKKTS

SEQ ID NO: 1840 - protein, 209 aa, Artificial Sequence
  source: /note="Description of Artificial Sequence: Synthetic polypeptide"
LEPGEKPYKCPECGKSFSDPGALVRHQRTHTGEKPYKCPECGKSFSTSGNLTEHQRTHTGEKPYKCPECGKSFSDPGHLVRHQRTHTGEKPYKCPECGKSFSDPGALVRHQRTHTGEKPYKCPECGKSFSQSSSLVRHQRTHTGEKPYKCPECGKSFSTHLDLIRHQRTHTGEKPYKCPECGKSFSERSHLREHQRTHTGEKPTGKKTS

SEQ ID NO: 1841 - protein, 209 aa, Artificial Sequence
  source: /note="Description of Artificial Sequence: Synthetic polypeptide"
LEPGEKPYKCPECGKSFSTSGNLTEHQRTHTGEKPYKCPECGKSFSDPGALVRHQRTHTGEKPYKCPECGKSFSTSGNLTEHQRTHTGEKPYKCPECGKSFSDPGHLVRHQRTHTGEKPYKCPECGKSFSDPGALVRHQRTHTGEKPYKCPECGKSFSQSSSLVRHQRTHTGEKPYKCPECGKSFSTHLDLIRHQRTHTGEKPTGKKTS

SEQ ID NO: 1842 - protein, 209 aa, Artificial Sequence
  source: /note="Description of Artificial Sequence: Synthetic polypeptide"
LEPGEKPYKCPECGKSFSDPGALVRHQRTHTGEKPYKCPECGKSFSTSGNLTEHQRTHTGEKPYKCPECGKSFSDPGALVRHQRTHTGEKPYKCPECGKSFSTSGNLTEHQRTHTGEKPYKCPECGKSFSDPGHLVRHQRTHTGEKPYKCPECGKSFSDPGALVRHQRTHTGEKPYKCPECGKSFSQSSSLVRHQRTHTGEKPTGKKTS

SEQ ID NO: 1843 - protein, 209 aa, Artificial Sequence
  source: /note="Description of Artificial Sequence: Synthetic polypeptide"
LEPGEKPYKCPECGKSFSDPGNLVRHQRTHTGEKPYKCPECGKSFSDPGALVRHQRTHTGEKPYKCPECGKSFSTSGNLTEHQRTHTGEKPYKCPECGKSFSDPGALVRHQRTHTGEKPYKCPECGKSFSTSGNLTEHQRTHTGEKPYKCPECGKSFSDPGHLVRHQRTHTGEKPYKCPECGKSFSDPGALVRHQRTHTGEKPTGKKTS

SEQ ID NO: 1844 - protein, 209 aa, Artificial Sequence
  source: /note="Description of Artificial Sequence: Synthetic polypeptide"
LEPGEKPYKCPECGKSFSRSDNLVRHQRTHTGEKPYKCPECGKSFSDPGNLVRHQRTHTGEKPYKCPECGKSFSDPGALVRHQRTHTGEKPYKCPECGKSFSTSGNLTEHQRTHTGEKPYKCPECGKSFSDPGALVRHQRTHTGEKPYKCPECGKSFSTSGNLTEHQRTHTGEKPYKCPECGKSFSDPGHLVRHQRTHTGEKPTGKKTS

SEQ ID NO: 1845 - protein, 209 aa, Artificial Sequence
  source: /note="Description of Artificial Sequence: Synthetic polypeptide"
LEPGEKPYKCPECGKSFSTSGHLVRHQRTHTGEKPYKCPECGKSFSRSDNLVRHQRTHTGEKPYKCPECGKSFSDPGNLVRHQRTHTGEKPYKCPECGKSFSDPGALVRHQRTHTGEKPYKCPECGKSFSTSGNLTEHQRTHTGEKPYKCPECGKSFSDPGALVRHQRTHTGEKPYKCPECGKSFSTSGNLTEHQRTHTGEKPTGKKTS

SEQ ID NO: 1846 - protein, 209 aa, Artificial Sequence
  source: /note="Description of Artificial Sequence: Synthetic polypeptide"
LEPGEKPYKCPECGKSFSSKKALTEHQRTHTGEKPYKCPECGKSFSDPGHLVRHQRTHTGEKPYKCPECGKSFSHTGHLLEHQRTHTGEKPYKCPECGKSFSHTGHLLEHQRTHTGEKPYKCPECGKSFSTSHSLTEHQRTHTGEKPYKCPECGKSFSTKNSLTEHQRTHTGEKPYKCPECGKSFSRNDALTEHQRTHTGEKPTGKKTS

SEQ ID NO: 1847 - protein, 209 aa, Artificial Sequence
  source: /note="Description of Artificial Sequence: Synthetic polypeptide"
LEPGEKPYKCPECGKSFSRNDALTEHQRTHTGEKPYKCPECGKSFSSKKALTEHQRTHTGEKPYKCPECGKSFSDPGHLVRHQRTHTGEKPYKCPECGKSFSHTGHLLEHQRTHTGEKPYKCPECGKSFSHTGHLLEHQRTHTGEKPYKCPECGKSFSTSHSLTEHQRTHTGEKPYKCPECGKSFSTKNSLTEHQRTHTGEKPTGKKTS

SEQ ID NO: 1848 - protein, 209 aa, Artificial Sequence
  source: /note="Description of Artificial Sequence: Synthetic polypeptide"
LEPGEKPYKCPECGKSFSSKKHLAEHQRTHTGEKPYKCPECGKSFSRNDALTEHQRTHTGEKPYKCPECGKSFSSKKALTEHQRTHTGEKPYKCPECGKSFSDPGHLVRHQRTHTGEKPYKCPECGKSFSHTGHLLEHQRTHTGEKPYKCPECGKSFSHTGHLLEHQRTHTGEKPYKCPECGKSFSTSHSLTEHQRTHTGEKPTGKKTS

SEQ ID NO: 1849 - protein, 209 aa, Artificial Sequence
  source: /note="Description of Artificial Sequence: Synthetic polypeptide"
LEPGEKPYKCPECGKSFSRSDHLTTHQRTHTGEKPYKCPECGKSFSSKKHLAEHQRTHTGEKPYKCPECGKSFSQNSTLTEHQRTHTGEKPYKCPECGKSFSDCRDLARHQRTHTGEKPYKCPECGKSFSTKNSLTEHQRTHTGEKPYKCPECGKSFSTSHSLTEHQRTHTGEKPYKCPECGKSFSRSDKLTEHQRTHTGEKPTGKKTS

SEQ ID NO: 1850 - protein, 209 aa, Artificial Sequence
  source: /note="Description of Artificial Sequence: Synthetic polypeptide"
LEPGEKPYKCPECGKSFSQNSTLTEHQRTHTGEKPYKCPECGKSFSDCRDLARHQRTHTGEKPYKCPECGKSFSTKNSLTEHQRTHTGEKPYKCPECGKSFSTSHSLTEHQRTHTGEKPYKCPECGKSFSRSDKLTEHQRTHTGEKPYKCPECGKSFSRNDTLTEHQRTHTGEKPYKCPECGKSFSRTDTLRDHQRTHTGEKPTGKKTS

SEQ ID NO: 1851 - protein, 209 aa, Artificial Sequence
  source: /note="Description of Artificial Sequence: Synthetic polypeptide"
LEPGEKPYKCPECGKSFSSKKHLAEHQRTHTGEKPYKCPECGKSFSQNSTLTEHQRTHTGEKPYKCPECGKSFSDCRDLARHQRTHTGEKPYKCPECGKSFSTKNSLTEHQRTHTGEKPYKCPECGKSFSTSHSLTEHQRTHTGEKPYKCPECGKSFSRSDKLTEHQRTHTGEKPYKCPECGKSFSRNDTLTEHQRTHTGEKPTGKKTS

SEQ ID NO: 1852 - protein, 209 aa, Artificial Sequence
  source: /note="Description of Artificial Sequence: Synthetic polypeptide"
LEPGEKPYKCPECGKSFSRSDDLVRHQRTHTGEKPYKCPECGKSFSRSDHLTTHQRTHTGEKPYKCPECGKSFSSKKHLAEHQRTHTGEKPYKCPECGKSFSQNSTLTEHQRTHTGEKPYKCPECGKSFSDCRDLARHQRTHTGEKPYKCPECGKSFSTKNSLTEHQRTHTGEKPYKCPECGKSFSTSHSLTEHQRTHTGEKPTGKKTS

SEQ ID NO: 1853 - protein, 209 aa, Artificial Sequence
  source: /note="Description of Artificial Sequence: Synthetic polypeptide"
LEPGEKPYKCPECGKSFSSKKHLAEHQRTHTGEKPYKCPECGKSFSRSDDLVRHQRTHTGEKPYKCPECGKSFSRSDHLTTHQRTHTGEKPYKCPECGKSFSSKKHLAEHQRTHTGEKPYKCPECGKSFSQNSTLTEHQRTHTGEKPYKCPECGKSFSDCRDLARHQRTHTGEKPYKCPECGKSFSTKNSLTEHQRTHTGEKPTGKKTS

SEQ ID NO: 1854 - protein, 209 aa, Artificial Sequence
  source: /note="Description of Artificial Sequence: Synthetic polypeptide"
LEPGEKPYKCPECGKSFSDKKDLTRHQRTHTGEKPYKCPECGKSFSSKKHLAEHQRTHTGEKPYKCPECGKSFSRSDDLVRHQRTHTGEKPYKCPECGKSFSRSDHLTTHQRTHTGEKPYKCPECGKSFSSKKHLAEHQRTHTGEKPYKCPECGKSFSQNSTLTEHQRTHTGEKPYKCPECGKSFSDCRDLARHQRTHTGEKPTGKKTS

SEQ ID NO: 1855 - protein, 209 aa, Artificial Sequence
  source: /note="Description of Artificial Sequence: Synthetic polypeptide"
LEPGEKPYKCPECGKSFSRKDNLKNHQRTHTGEKPYKCPECGKSFSRNDTLTEHQRTHTGEKPYKCPECGKSFSDKKDLTRHQRTHTGEKPYKCPECGKSFSSKKHLAEHQRTHTGEKPYKCPECGKSFSRSDDLVRHQRTHTGEKPYKCPECGKSFSRSDHLTTHQRTHTGEKPYKCPECGKSFSSKKHLAEHQRTHTGEKPTGKKTS

SEQ ID NO: 1856 - protein, 209 aa, Artificial Sequence
  source: /note="Description of Artificial Sequence: Synthetic polypeptide"
LEPGEKPYKCPECGKSFSDCRDLARHQRTHTGEKPYKCPECGKSFSRKDNLKNHQRTHTGEKPYKCPECGKSFSRNDTLTEHQRTHTGEKPYKCPECGKSFSDKKDLTRHQRTHTGEKPYKCPECGKSFSSKKHLAEHQRTHTGEKPYKCPECGKSFSRSDDLVRHQRTHTGEKPYKCPECGKSFSRSDHLTTHQRTHTGEKPTGKKTS

SEQ ID NO: 1857 - protein, 209 aa, Artificial Sequence
  source: /note="Description of Artificial Sequence: Synthetic polypeptide"
LEPGEKPYKCPECGKSFSRNDTLTEHQRTHTGEKPYKCPECGKSFSDKKDLTRHQRTHTGEKPYKCPECGKSFSSKKHLAEHQRTHTGEKPYKCPECGKSFSRSDDLVRHQRTHTGEKPYKCPECGKSFSRSDHLTTHQRTHTGEKPYKCPECGKSFSSKKHLAEHQRTHTGEKPYKCPECGKSFSQNSTLTEHQRTHTGEKPTGKKTS

SEQ ID NO: 1858 - protein, 209 aa, Artificial Sequence
  source: /note="Description of Artificial Sequence: Synthetic polypeptide"
LEPGEKPYKCPECGKSFSDCRDLARHQRTHTGEKPYKCPECGKSFSSKKHLAEHQRTHTGEKPYKCPECGKSFSDCRDLARHQRTHTGEKPYKCPECGKSFSRKDNLKNHQRTHTGEKPYKCPECGKSFSRNDTLTEHQRTHTGEKPYKCPECGKSFSDKKDLTRHQRTHTGEKPYKCPECGKSFSSKKHLAEHQRTHTGEKPTGKKTS

SEQ ID NO: 1859 - protein, 209 aa, Artificial Sequence
  source: /note="Description of Artificial Sequence: Synthetic polypeptide"
LEPGEKPYKCPECGKSFSSKKHLAEHQRTHTGEKPYKCPECGKSFSDCRDLARHQRTHTGEKPYKCPECGKSFSRKDNLKNHQRTHTGEKPYKCPECGKSFSRNDTLTEHQRTHTGEKPYKCPECGKSFSDKKDLTRHQRTHTGEKPYKCPECGKSFSSKKHLAEHQRTHTGEKPYKCPECGKSFSRSDDLVRHQRTHTGEKPTGKKTS

SEQ ID NO: 1860 - protein, 209 aa, Artificial Sequence
  source: /note="Description of Artificial Sequence: Synthetic polypeptide"
LEPGEKPYKCPECGKSFSSKKHLAEHQRTHTGEKPYKCPECGKSFSSKKALTEHQRTHTGEKPYKCPECGKSFSDCRDLARHQRTHTGEKPYKCPECGKSFSDPGHLVRHQRTHTGEKPYKCPECGKSFSRNDALTEHQRTHTGEKPYKCPECGKSFSDKKDLTRHQRTHTGEKPYKCPECGKSFSTKNSLTEHQRTHTGEKPTGKKTS

SEQ ID NO: 1861 - protein, 209 aa, Artificial Sequence
  source: /note="Description of Artificial Sequence: Synthetic polypeptide"
LEPGEKPYKCPECGKSFSDPGHLVRHQRTHTGEKPYKCPECGKSFSQSSNLVRHQRTHTGEKPYKCPECGKSFSSKKHLAEHQRTHTGEKPYKCPECGKSFSSKKALTEHQRTHTGEKPYKCPECGKSFSDCRDLARHQRTHTGEKPYKCPECGKSFSDPGHLVRHQRTHTGEKPYKCPECGKSFSRNDALTEHQRTHTGEKPTGKKTS

SEQ ID NO: 1862 - protein, 209 aa, Artificial Sequence
  source: /note="Description of Artificial Sequence: Synthetic polypeptide"
LEPGEKPYKCPECGKSFSSKKHLAEHQRTHTGEKPYKCPECGKSFSDPGHLVRHQRTHTGEKPYKCPECGKSFSQSSNLVRHQRTHTGEKPYKCPECGKSFSSKKHLAEHQRTHTGEKPYKCPECGKSFSSKKALTEHQRTHTGEKPYKCPECGKSFSDCRDLARHQRTHTGEKPYKCPECGKSFSDPGHLVRHQRTHTGEKPTGKKTS

SEQ ID NO: 1863 - protein, 209 aa, Artificial Sequence
  source: /note="Description of Artificial Sequence: Synthetic polypeptide"
LEPGEKPYKCPECGKSFSTKNSLTEHQRTHTGEKPYKCPECGKSFSHTGHLLEHQRTHTGEKPYKCPECGKSFSSKKHLAEHQRTHTGEKPYKCPECGKSFSDPGHLVRHQRTHTGEKPYKCPECGKSFSQSSNLVRHQRTHTGEKPYKCPECGKSFSSKKHLAEHQRTHTGEKPYKCPECGKSFSSKKALTEHQRTHTGEKPTGKKTS

SEQ ID NO: 1864 - protein, 209 aa, Artificial Sequence
  source: /note="Description of Artificial Sequence: Synthetic polypeptide"
LEPGEKPYKCPECGKSFSHTGHLLEHQRTHTGEKPYKCPECGKSFSSKKHLAEHQRTHTGEKPYKCPECGKSFSDPGHLVRHQRTHTGEKPYKCPECGKSFSQSSNLVRHQRTHTGEKPYKCPECGKSFSSKKHLAEHQRTHTGEKPYKCPECGKSFSSKKALTEHQRTHTGEKPYKCPECGKSFSDCRDLARHQRTHTGEKPTGKKTS

SEQ ID NO: 1865 - protein, 209 aa, Artificial Sequence
  source: /note="Description of Artificial Sequence: Synthetic polypeptide"
LEPGEKPYKCPECGKSFSRNDTLTEHQRTHTGEKPYKCPECGKSFSTKNSLTEHQRTHTGEKPYKCPECGKSFSHTGHLLEHQRTHTGEKPYKCPECGKSFSSKKHLAEHQRTHTGEKPYKCPECGKSFSDPGHLVRHQRTHTGEKPYKCPECGKSFSQSSNLVRHQRTHTGEKPYKCPECGKSFSSKKHLAEHQRTHTGEKPTGKKTS

SEQ ID NO: 1866 - protein, 209 aa, Artificial Sequence
  source: /note="Description of Artificial Sequence: Synthetic polypeptide"
LEPGEKPYKCPECGKSFSSKKHLAEHQRTHTGEKPYKCPECGKSFSRNDTLTEHQRTHTGEKPYKCPECGKSFSTKNSLTEHQRTHTGEKPYKCPECGKSFSHTGHLLEHQRTHTGEKPYKCPECGKSFSSKKHLAEHQRTHTGEKPYKCPECGKSFSDPGHLVRHQRTHTGEKPYKCPECGKSFSQSSNLVRHQRTHTGEKPTGKKTS

SEQ ID NO: 1867 - protein, 209 aa, Artificial Sequence
  source: /note="Description of Artificial Sequence: Synthetic polypeptide"
LEPGEKPYKCPECGKSFSRSDHLTNHQRTHTGEKPYKCPECGKSFSQSGHLTEHQRTHTGEKPYKCPECGKSFSSKKHLAEHQRTHTGEKPYKCPECGKSFSTSHSLTEHQRTHTGEKPYKCPECGKSFSHTGHLLEHQRTHTGEKPYKCPECGKSFSRSDKLVRHQRTHTGEKPYKCPECGKSFSTKNSLTEHQRTHTGEKPTGKKTS

SEQ ID NO: 1868 - protein, 209 aa, Artificial Sequence
  source: /note="Description of Artificial Sequence: Synthetic polypeptide"
LEPGEKPYKCPECGKSFSSKKHLAEHQRTHTGEKPYKCPECGKSFSRSDHLTNHQRTHTGEKPYKCPECGKSFSQSGHLTEHQRTHTGEKPYKCPECGKSFSSKKHLAEHQRTHTGEKPYKCPECGKSFSTSHSLTEHQRTHTGEKPYKCPECGKSFSHTGHLLEHQRTHTGEKPYKCPECGKSFSRSDKLVRHQRTHTGEKPTGKKTS

SEQ ID NO: 1869 - protein, 209 aa, Artificial Sequence
  source: /note="Description of Artificial Sequence: Synthetic polypeptide"
LEPGEKPYKCPECGKSFSRNDTLTEHQRTHTGEKPYKCPECGKSFSSKKHLAEHQRTHTGEKPYKCPECGKSFSRSDHLTNHQRTHTGEKPYKCPECGKSFSQSGHLTEHQRTHTGEKPYKCPECGKSFSSKKHLAEHQRTHTGEKPYKCPECGKSFSTSHSLTEHQRTHTGEKPYKCPECGKSFSHTGHLLEHQRTHTGEKPTGKKTS

SEQ ID NO: 1870 - protein, 209 aa, Artificial Sequence
  source: /note="Description of Artificial Sequence: Synthetic polypeptide"
LEPGEKPYKCPECGKSFSSKKHLAEHQRTHTGEKPYKCPECGKSFSRNDTLTEHQRTHTGEKPYKCPECGKSFSSKKHLAEHQRTHTGEKPYKCPECGKSFSRSDHLTNHQRTHTGEKPYKCPECGKSFSQSGHLTEHQRTHTGEKPYKCPECGKSFSSKKHLAEHQRTHTGEKPYKCPECGKSFSTSHSLTEHQRTHTGEKPTGKKTS

SEQ ID NO: 1871 - protein, 209 aa, Artificial Sequence
  source: /note="Description of Artificial Sequence: Synthetic polypeptide"
LEPGEKPYKCPECGKSFSDCRDLARHQRTHTGEKPYKCPECGKSFSHRTTLTNHQRTHTGEKPYKCPECGKSFSSKKHLAEHQRTHTGEKPYKCPECGKSFSTKNSLTEHQRTHTGEKPYKCPECGKSFSTKNSLTEHQRTHTGEKPYKCPECGKSFSRNDALTEHQRTHTGEKPYKCPECGKSFSTSHSLTEHQRTHTGEKPTGKKTS

SEQ ID NO: 1872 - protein, 209 aa, Artificial Sequence
  source: /note="Description of Artificial Sequence: Synthetic polypeptide"
LEPGEKPYKCPECGKSFSDPGALVRHQRTHTGEKPYKCPECGKSFSQRAHLERHQRTHTGEKPYKCPECGKSFSRNDALTEHQRTHTGEKPYKCPECGKSFSRNDALTEHQRTHTGEKPYKCPECGKSFSTSGNLVRHQRTHTGEKPYKCPECGKSFSQSSNLVRHQRTHTGEKPYKCPECGKSFSRSDHLTTHQRTHTGEKPTGKKTS

SEQ ID NO: 1873 - protein, 209 aa, Artificial Sequence
  source: /note="Description of Artificial Sequence: Synthetic polypeptide"
LEPGEKPYKCPECGKSFSDCRDLARHQRTHTGEKPYKCPECGKSFSQNSTLTEHQRTHTGEKPYKCPECGKSFSDPGHLVRHQRTHTGEKPYKCPECGKSFSTTGALTEHQRTHTGEKPYKCPECGKSFSHRTTLTNHQRTHTGEKPYKCPECGKSFSRSDKLVRHQRTHTGEKPYKCPECGKSFSTSGELVRHQRTHTGEKPTGKKTS

SEQ ID NO: 1874 - protein, 209 aa, Artificial Sequence
  source: /note="Description of Artificial Sequence: Synthetic polypeptide"
LEPGEKPYKCPECGKSFSTSGHLVRHQRTHTGEKPYKCPECGKSFSRSDHLTNHQRTHTGEKPYKCPECGKSFSQAGHLASHQRTHTGEKPYKCPECGKSFSRNDALTEHQRTHTGEKPYKCPECGKSFSTKNSLTEHQRTHTGEKPYKCPECGKSFSREDNLHTHQRTHTGEKPYKCPECGKSFSDCRDLARHQRTHTGEKPTGKKTS

SEQ ID NO: 1875 - protein, 209 aa, Artificial Sequence
  source: /note="Description of Artificial Sequence: Synthetic polypeptide"
LEPGEKPYKCPECGKSFSQRAHLERHQRTHTGEKPYKCPECGKSFSTSGHLVRHQRTHTGEKPYKCPECGKSFSRSDHLTNHQRTHTGEKPYKCPECGKSFSQAGHLASHQRTHTGEKPYKCPECGKSFSRNDALTEHQRTHTGEKPYKCPECGKSFSTKNSLTEHQRTHTGEKPYKCPECGKSFSREDNLHTHQRTHTGEKPTGKKTS

SEQ ID NO: 1876 - protein, 209 aa, Artificial Sequence
  source: /note="Description of Artificial Sequence: Synthetic polypeptide"
LEPGEKPYKCPECGKSFSDPGHLVRHQRTHTGEKPYKCPECGKSFSQRAHLERHQRTHTGEKPYKCPECGKSFSTSGHLVRHQRTHTGEKPYKCPECGKSFSRSDHLTNHQRTHTGEKPYKCPECGKSFSQAGHLASHQRTHTGEKPYKCPECGKSFSRNDALTEHQRTHTGEKPYKCPECGKSFSTKNSLTEHQRTHTGEKPTGKKTS

SEQ ID NO: 1877 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSRNDTLTEHQRTHTGEKPYKCPECGKSFSRNDALTEHQRTHTGEKPYKCPECGKSFSTSGELVRHQRTHTGEKPYKCPECGKSFSRSDNLVRHQRTHTGEKPYKCPECGKSFSRSDELVRHQRTHTGEKPYKCPECGKSFSRSDKLVRHQRTHTGEKPTGKKTS

SEQ ID NO: 1878 - protein, 209 aa, Artificial Sequence
  source: /note="Description of Artificial Sequence: Synthetic polypeptide"
LEPGEKPYKCPECGKSFSRSDHLTNHQRTHTGEKPYKCPECGKSFSRSDKLVRHQRTHTGEKPYKCPECGKSFSRNDTLTEHQRTHTGEKPYKCPECGKSFSRNDALTEHQRTHTGEKPYKCPECGKSFSTSGELVRHQRTHTGEKPYKCPECGKSFSRSDNLVRHQRTHTGEKPYKCPECGKSFSRSDELVRHQRTHTGEKPTGKKTS

SEQ ID NO: 1879 - protein, 209 aa, Artificial Sequence
  source: /note="Description of Artificial Sequence: Synthetic polypeptide"
LEPGEKPYKCPECGKSFSTSGHLVRHQRTHTGEKPYKCPECGKSFSRSDHLTNHQRTHTGEKPYKCPECGKSFSRSDKLVRHQRTHTGEKPYKCPECGKSFSRNDTLTEHQRTHTGEKPYKCPECGKSFSRNDALTEHQRTHTGEKPYKCPECGKSFSTSGELVRHQRTHTGEKPYKCPECGKSFSRSDNLVRHQRTHTGEKPTGKKTS

SEQ ID NO: 1880 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSTSGHLVRHQRTHTGEKPYKCPECGKSFSRSDHLTNHQRTHTGEKPYKCPECGKSFSRSDKLVRHQRTHTGEKPYKCPECGKSFSRNDTLTEHQRTHTGEKPYKCPECGKSFSRNDALTEHQRTHTGEKPYKCPECGKSFSTSGELVRHQRTHTGEKPTGKKTS

SEQ ID NO: 1881 - protein, 209 aa, Artificial Sequence
  source: /note="Description of Artificial Sequence: Synthetic polypeptide"
LEPGEKPYKCPECGKSFSTSGHLVRHQRTHTGEKPYKCPECGKSFSRSDKLVRHQRTHTGEKPYKCPECGKSFSTSGHLVRHQRTHTGEKPYKCPECGKSFSRSDHLTNHQRTHTGEKPYKCPECGKSFSRSDKLVRHQRTHTGEKPYKCPECGKSFSRNDTLTEHQRTHTGEKPYKCPECGKSFSRNDALTEHQRTHTGEKPTGKKTS

SEQ ID NO: 1882 - protein, 209 aa, Artificial Sequence
  source: /note="Description of Artificial Sequence: Synthetic polypeptide"
LEPGEKPYKCPECGKSFSTTGNLTVHQRTHTGEKPYKCPECGKSFSTSGSLVRHQRTHTGEKPYKCPECGKSFSRSDKLVRHQRTHTGEKPYKCPECGKSFSRSDELVRHQRTHTGEKPYKCPECGKSFSRSDKLVRHQRTHTGEKPYKCPECGKSFSQRAHLERHQRTHTGEKPYKCPECGKSFSRSDKLTEHQRTHTGEKPTGKKTS

SEQ ID NO: 1883 - protein, 209 aa, Artificial Sequence
  source: /note="Description of Artificial Sequence: Synthetic polypeptide"
LEPGEKPYKCPECGKSFSRSDHLTTHQRTHTGEKPYKCPECGKSFSHKNALQNHQRTHTGEKPYKCPECGKSFSRSDKLVRHQRTHTGEKPYKCPECGKSFSQSGDLRRHQRTHTGEKPYKCPECGKSFSTSGELVRHQRTHTGEKPYKCPECGKSFSRSDKLVRHQRTHTGEKPYKCPECGKSFSDPGHLVRHQRTHTGEKPTGKKTS

SEQ ID NO: 1884 - protein, 209 aa, Artificial Sequence
  source: /note="Description of Artificial Sequence: Synthetic polypeptide"
LEPGEKPYKCPECGKSFSHKNALQNHQRTHTGEKPYKCPECGKSFSRSDKLVRHQRTHTGEKPYKCPECGKSFSQSGDLRRHQRTHTGEKPYKCPECGKSFSTSGELVRHQRTHTGEKPYKCPECGKSFSRSDKLVRHQRTHTGEKPYKCPECGKSFSDPGHLVRHQRTHTGEKPYKCPECGKSFSRNDALTEHQRTHTGEKPTGKKTS

SEQ ID NO: 1885 - protein, 209 aa, Artificial Sequence
  source: /note="Description of Artificial Sequence: Synthetic polypeptide"
LEPGEKPYKCPECGKSFSRNDALTEHQRTHTGEKPYKCPECGKSFSRSDHLTTHQRTHTGEKPYKCPECGKSFSHKNALQNHQRTHTGEKPYKCPECGKSFSRSDKLVRHQRTHTGEKPYKCPECGKSFSQSGDLRRHQRTHTGEKPYKCPECGKSFSTSGELVRHQRTHTGEKPYKCPECGKSFSRSDKLVRHQRTHTGEKPTGKKTS

SEQ ID NO: 1886 - protein, 209 aa, Artificial Sequence
  source: /note="Description of Artificial Sequence: Synthetic polypeptide"
LEPGEKPYKCPECGKSFSTSGELVRHQRTHTGEKPYKCPECGKSFSRSDKLVRHQRTHTGEKPYKCPECGKSFSDPGHLVRHQRTHTGEKPYKCPECGKSFSRNDALTEHQRTHTGEKPYKCPECGKSFSRSDHLTNHQRTHTGEKPYKCPECGKSFSTSGNLVRHQRTHTGEKPYKCPECGKSFSRSDELVRHQRTHTGEKPTGKKTS

SEQ ID NO: 1887 - protein, 209 aa, Artificial Sequence
  source: /note="Description of Artificial Sequence: Synthetic polypeptide"
LEPGEKPYKCPECGKSFSQSGDLRRHQRTHTGEKPYKCPECGKSFSTSGELVRHQRTHTGEKPYKCPECGKSFSRSDKLVRHQRTHTGEKPYKCPECGKSFSDPGHLVRHQRTHTGEKPYKCPECGKSFSRNDALTEHQRTHTGEKPYKCPECGKSFSRSDHLTNHQRTHTGEKPYKCPECGKSFSTSGNLVRHQRTHTGEKPTGKKTS

SEQ ID NO: 1888 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSDPGHLVRHQRTHTGEKPYKCPECGKSFSRNDALTEHQRTHTGEKPYKCPECGKSFSRSDHLTNHQRTHTGEKPYKCPECGKSFSTSGNLVRHQRTHTGEKPYKCPECGKSFSRSDELVRHQRTHTGEKPYKCPECGKSFSRNDTLTEHQRTHTGEKPTGKKTS

SEQ ID NO: 1889 - protein, 209 aa, Artificial Sequence
  source: /note="Description of Artificial Sequence: Synthetic polypeptide"
LEPGEKPYKCPECGKSFSDPGHLVRHQRTHTGEKPYKCPECGKSFSRNDALTEHQRTHTGEKPYKCPECGKSFSRSDHLTNHQRTHTGEKPYKCPECGKSFSTSGNLVRHQRTHTGEKPYKCPECGKSFSRSDELVRHQRTHTGEKPYKCPECGKSFSRNDTLTEHQRTHTGEKPYKCPECGKSFSRNDTLTEHQRTHTGEKPTGKKTS

SEQ ID NO: 1890 - protein, 209 aa, Artificial Sequence
  source: /note="Description of Artificial Sequence: Synthetic polypeptide"
LEPGEKPYKCPECGKSFSRNDALTEHQRTHTGEKPYKCPECGKSFSRSDHLTNHQRTHTGEKPYKCPECGKSFSTSGNLVRHQRTHTGEKPYKCPECGKSFSRSDELVRHQRTHTGEKPYKCPECGKSFSRNDTLTEHQRTHTGEKPYKCPECGKSFSRNDTLTEHQRTHTGEKPYKCPECGKSFSSKKHLAEHQRTHTGEKPTGKKTS

SEQ ID NO: 1891 - protein, 209 aa, Artificial Sequence
  source: /note="Description of Artificial Sequence: Synthetic polypeptide"
LEPGEKPYKCPECGKSFSRSDHLTNHQRTHTGEKPYKCPECGKSFSTSGNLVRHQRTHTGEKPYKCPECGKSFSRSDELVRHQRTHTGEKPYKCPECGKSFSRNDTLTEHQRTHTGEKPYKCPECGKSFSRNDTLTEHQRTHTGEKPYKCPECGKSFSSKKHLAEHQRTHTGEKPYKCPECGKSFSTSGHLVRHQRTHTGEKPTGKKTS

SEQ ID NO: 1892 - protein, 209 aa, Artificial Sequence
  source: /note="Description of Artificial Sequence: Synthetic polypeptide"
LEPGEKPYKCPECGKSFSRADNLTEHQRTHTGEKPYKCPECGKSFSRNDALTEHQRTHTGEKPYKCPECGKSFSRSDKLVRHQRTHTGEKPYKCPECGKSFSRSDDLVRHQRTHTGEKPYKCPECGKSFSRSDHLTTHQRTHTGEKPYKCPECGKSFSDPGHLVRHQRTHTGEKPYKCPECGKSFSQKSSLIAHQRTHTGEKPTGKKTS

SEQ ID NO: 1893 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSRSDDLVRHQRTHTGEKPYKCPECGKSFSRSDHLTTHQRTHTGEKPYKCPECGKSFSDPGHLVRHQRTHTGEKPYKCPECGKSFSQKSSLIAHQRTHTGEKPYKCPECGKSFSRSDHLTTHQRTHTGEKPYKCPECGKSFSRSDKLTEHQRTHTGEKPTGKKTS

SEQ ID NO: 1894 - protein, 209 aa, Artificial Sequence
  source: /note="Description of Artificial Sequence: Synthetic polypeptide"
LEPGEKPYKCPECGKSFSRNDALTEHQRTHTGEKPYKCPECGKSFSRSDKLVRHQRTHTGEKPYKCPECGKSFSRSDDLVRHQRTHTGEKPYKCPECGKSFSRSDHLTTHQRTHTGEKPYKCPECGKSFSDPGHLVRHQRTHTGEKPYKCPECGKSFSQKSSLIAHQRTHTGEKPYKCPECGKSFSRSDHLTTHQRTHTGEKPTGKKTS

SEQ ID NO: 1895 - protein, 209 aa, Artificial Sequence
  source: /note="Description of Artificial Sequence: Synthetic polypeptide"
LEPGEKPYKCPECGKSFSRSDDLVRHQRTHTGEKPYKCPECGKSFSRSDHLTTHQRTHTGEKPYKCPECGKSFSDPGHLVRHQRTHTGEKPYKCPECGKSFSQKSSLIAHQRTHTGEKPYKCPECGKSFSRSDHLTTHQRTHTGEKPYKCPECGKSFSRSDKLTEHQRTHTGEKPYKCPECGKSFSHTGHLLEHQRTHTGEKPTGKKTS

SEQ ID NO: 1896 - protein, 209 aa, Artificial Sequence
  source: /note="Description of Artificial Sequence: Synthetic polypeptide"
LEPGEKPYKCPECGKSFSDPGHLVRHQRTHTGEKPYKCPECGKSFSQKSSLIAHQRTHTGEKPYKCPECGKSFSRSDHLTTHQRTHTGEKPYKCPECGKSFSRSDKLTEHQRTHTGEKPYKCPECGKSFSHTGHLLEHQRTHTGEKPYKCPECGKSFSSKKHLAEHQRTHTGEKPYKCPECGKSFSDPGALVRHQRTHTGEKPTGKKTS

SEQ ID NO: 1897 - protein, 209 aa, Artificial Sequence
  source: /note="Description of Artificial Sequence: Synthetic polypeptide"
LEPGEKPYKCPECGKSFSRSDHLTTHQRTHTGEKPYKCPECGKSFSDPGHLVRHQRTHTGEKPYKCPECGKSFSQKSSLIAHQRTHTGEKPYKCPECGKSFSRSDHLTTHQRTHTGEKPYKCPECGKSFSRSDKLTEHQRTHTGEKPYKCPECGKSFSHTGHLLEHQRTHTGEKPYKCPECGKSFSSKKHLAEHQRTHTGEKPTGKKTS

SEQ ID NO: 1898 - protein, 209 aa, Artificial Sequence
  source: /note="Description of Artificial Sequence: Synthetic polypeptide"
LEPGEKPYKCPECGKSFSQRAHLERHQRTHTGEKPYKCPECGKSFSRADNLTEHQRTHTGEKPYKCPECGKSFSRNDALTEHQRTHTGEKPYKCPECGKSFSRSDKLVRHQRTHTGEKPYKCPECGKSFSRSDDLVRHQRTHTGEKPYKCPECGKSFSRSDHLTTHQRTHTGEKPYKCPECGKSFSDPGHLVRHQRTHTGEKPTGKKTS

SEQ ID NO: 1899 - protein, 209 aa, Artificial Sequence
  source: /note="Description of Artificial Sequence: Synthetic polypeptide"
LEPGEKPYKCPECGKSFSDPGHLVRHQRTHTGEKPYKCPECGKSFSRSDKLTEHQRTHTGEKPYKCPECGKSFSRSDKLVRHQRTHTGEKPYKCPECGKSFSTSGELVRHQRTHTGEKPYKCPECGKSFSREDNLHTHQRTHTGEKPYKCPECGKSFSQRAHLERHQRTHTGEKPYKCPECGKSFSTSGHLVRHQRTHTGEKPTGKKTS

SEQ ID NO: 1900 - protein, 209 aa, Artificial Sequence
  source: /note="Description of Artificial Sequence: Synthetic polypeptide"
LEPGEKPYKCPECGKSFSRSDKLTEHQRTHTGEKPYKCPECGKSFSRSDKLVRHQRTHTGEKPYKCPECGKSFSTSGELVRHQRTHTGEKPYKCPECGKSFSREDNLHTHQRTHTGEKPYKCPECGKSFSQRAHLERHQRTHTGEKPYKCPECGKSFSTSGHLVRHQRTHTGEKPYKCPECGKSFSDCRDLARHQRTHTGEKPTGKKTS

SEQ ID NO: 1901 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSTSGELVRHQRTHTGEKPYKCPECGKSFSREDNLHTHQRTHTGEKPYKCPECGKSFSQRAHLERHQRTHTGEKPYKCPECGKSFSTSGHLVRHQRTHTGEKPYKCPECGKSFSDCRDLARHQRTHTGEKPYKCPECGKSFSSKKHLAEHQRTHTGEKPTGKKTS

SEQ ID NO: 1902 - protein, 209 aa, Artificial Sequence
  source: /note="Description of Artificial Sequence: Synthetic polypeptide"
LEPGEKPYKCPECGKSFSTTGNLTVHQRTHTGEKPYKCPECGKSFSTSGELVRHQRTHTGEKPYKCPECGKSFSTSGHLVRHQRTHTGEKPYKCPECGKSFSRSDKLTEHQRTHTGEKPYKCPECGKSFSDKKDLTRHQRTHTGEKPYKCPECGKSFSDPGNLVRHQRTHTGEKPYKCPECGKSFSTSGELVRHQRTHTGEKPTGKKTS

SEQ ID NO: 1903 - protein, 209 aa, Artificial Sequence
  source: /note="Description of Artificial Sequence: Synthetic polypeptide"
LEPGEKPYKCPECGKSFSTSGELVRHQRTHTGEKPYKCPECGKSFSTSGHLVRHQRTHTGEKPYKCPECGKSFSRSDKLTEHQRTHTGEKPYKCPECGKSFSDKKDLTRHQRTHTGEKPYKCPECGKSFSDPGNLVRHQRTHTGEKPYKCPECGKSFSTSGELVRHQRTHTGEKPYKCPECGKSFSRNDALTEHQRTHTGEKPTGKKTS

SEQ ID NO: 1904 - protein, 209 aa, Artificial Sequence
  source: /note="Description of Artificial Sequence: Synthetic polypeptide"
LEPGEKPYKCPECGKSFSTHLDLIRHQRTHTGEKPYKCPECGKSFSQNSTLTEHQRTHTGEKPYKCPECGKSFSDCRDLARHQRTHTGEKPYKCPECGKSFSRSDKLVRHQRTHTGEKPYKCPECGKSFSTSGELVRHQRTHTGEKPYKCPECGKSFSTHLDLIRHQRTHTGEKPYKCPECGKSFSSPADLTRHQRTHTGEKPTGKKTS

SEQ ID NO: 1905 - protein, 209 aa, Artificial Sequence
  source: /note="Description of Artificial Sequence: Synthetic polypeptide"
LEPGEKPYKCPECGKSFSDCRDLARHQRTHTGEKPYKCPECGKSFSRSDKLVRHQRTHTGEKPYKCPECGKSFSTSGELVRHQRTHTGEKPYKCPECGKSFSTHLDLIRHQRTHTGEKPYKCPECGKSFSSPADLTRHQRTHTGEKPYKCPECGKSFSHKNALQNHQRTHTGEKPYKCPECGKSFSQNSTLTEHQRTHTGEKPTGKKTS

SEQ ID NO: 1906 - protein, 209 aa, Artificial Sequence
  source: /note="Description of Artificial Sequence: Synthetic polypeptide"
LEPGEKPYKCPECGKSFSQNSTLTEHQRTHTGEKPYKCPECGKSFSDCRDLARHQRTHTGEKPYKCPECGKSFSRSDKLVRHQRTHTGEKPYKCPECGKSFSTSGELVRHQRTHTGEKPYKCPECGKSFSTHLDLIRHQRTHTGEKPYKCPECGKSFSSPADLTRHQRTHTGEKPYKCPECGKSFSHKNALQNHQRTHTGEKPTGKKTS

SEQ ID NO: 1907 - protein, 209 aa, Artificial Sequence
  source: /note="Description of Artificial Sequence: Synthetic polypeptide"
LEPGEKPYKCPECGKSFSRSDKLVRHQRTHTGEKPYKCPECGKSFSTSGELVRHQRTHTGEKPYKCPECGKSFSTHLDLIRHQRTHTGEKPYKCPECGKSFSSPADLTRHQRTHTGEKPYKCPECGKSFSHKNALQNHQRTHTGEKPYKCPECGKSFSQNSTLTEHQRTHTGEKPYKCPECGKSFSRSDELVRHQRTHTGEKPTGKKTS

SEQ ID NO: 1908 - protein, 209 aa, Artificial Sequence
  source: /note="Description of Artificial Sequence: Synthetic polypeptide"
LEPGEKPYKCPECGKSFSTSGELVRHQRTHTGEKPYKCPECGKSFSTHLDLIRHQRTHTGEKPYKCPECGKSFSSPADLTRHQRTHTGEKPYKCPECGKSFSHKNALQNHQRTHTGEKPYKCPECGKSFSQNSTLTEHQRTHTGEKPYKCPECGKSFSRSDELVRHQRTHTGEKPYKCPECGKSFSRSDKLVRHQRTHTGEKPTGKKTS

SEQ ID NO: 1909 - protein, 209 aa, Artificial Sequence
  source: /note="Description of Artificial Sequence: Synthetic polypeptide"
LEPGEKPYKCPECGKSFSSKKALTEHQRTHTGEKPYKCPECGKSFSTHLDLIRHQRTHTGEKPYKCPECGKSFSQNSTLTEHQRTHTGEKPYKCPECGKSFSDCRDLARHQRTHTGEKPYKCPECGKSFSRSDKLVRHQRTHTGEKPYKCPECGKSFSTSGELVRHQRTHTGEKPYKCPECGKSFSTHLDLIRHQRTHTGEKPTGKKTS

SEQ ID NO: 1910 - protein, 209 aa, Artificial Sequence
  source: /note="Description of Artificial Sequence: Synthetic polypeptide"
LEPGEKPYKCPECGKSFSTHLDLIRHQRTHTGEKPYKCPECGKSFSSPADLTRHQRTHTGEKPYKCPECGKSFSHKNALQNHQRTHTGEKPYKCPECGKSFSQNSTLTEHQRTHTGEKPYKCPECGKSFSRSDELVRHQRTHTGEKPYKCPECGKSFSRSDKLVRHQRTHTGEKPYKCPECGKSFSSKKHLAEHQRTHTGEKPTGKKTS

SEQ ID NO: 1911 - protein, 209 aa, Artificial Sequence
  source: /note="Description of Artificial Sequence: Synthetic polypeptide"
LEPGEKPYKCPECGKSFSQNSTLTEHQRTHTGEKPYKCPECGKSFSRSDELVRHQRTHTGEKPYKCPECGKSFSRSDKLVRHQRTHTGEKPYKCPECGKSFSSKKHLAEHQRTHTGEKPYKCPECGKSFSSPADLTRHQRTHTGEKPYKCPECGKSFSRNDALTEHQRTHTGEKPYKCPECGKSFSRSDHLTTHQRTHTGEKPTGKKTS

SEQ ID NO: 1912 - protein, 209 aa, Artificial Sequence
  source: /note="Description of Artificial Sequence: Synthetic polypeptide"
LEPGEKPYKCPECGKSFSSPADLTRHQRTHTGEKPYKCPECGKSFSHKNALQNHQRTHTGEKPYKCPECGKSFSQNSTLTEHQRTHTGEKPYKCPECGKSFSRSDELVRHQRTHTGEKPYKCPECGKSFSRSDKLVRHQRTHTGEKPYKCPECGKSFSSKKHLAEHQRTHTGEKPYKCPECGKSFSSPADLTRHQRTHTGEKPTGKKTS

SEQ ID NO: 1913 - protein, 209 aa, Artificial Sequence
  source: /note="Description of Artificial Sequence: Synthetic polypeptide"
LEPGEKPYKCPECGKSFSHKNALQNHQRTHTGEKPYKCPECGKSFSQNSTLTEHQRTHTGEKPYKCPECGKSFSRSDELVRHQRTHTGEKPYKCPECGKSFSRSDKLVRHQRTHTGEKPYKCPECGKSFSSKKHLAEHQRTHTGEKPYKCPECGKSFSSPADLTRHQRTHTGEKPYKCPECGKSFSRNDALTEHQRTHTGEKPTGKKTS

SEQ ID NO: 1914 - protein, 209 aa, Artificial Sequence
  source: /note="Description of Artificial Sequence: Synthetic polypeptide"
LEPGEKPYKCPECGKSFSQSGHLTEHQRTHTGEKPYKCPECGKSFSSKKALTEHQRTHTGEKPYKCPECGKSFSTHLDLIRHQRTHTGEKPYKCPECGKSFSQNSTLTEHQRTHTGEKPYKCPECGKSFSDCRDLARHQRTHTGEKPYKCPECGKSFSRSDKLVRHQRTHTGEKPYKCPECGKSFSTSGELVRHQRTHTGEKPTGKKTS

SEQ ID NO: 1915 - protein, 209 aa, Artificial Sequence
  source: /note="Description of Artificial Sequence: Synthetic polypeptide"
LEPGEKPYKCPECGKSFSTSGNLTEHQRTHTGEKPYKCPECGKSFSTSGNLTEHQRTHTGEKPYKCPECGKSFSRSDHLTNHQRTHTGEKPYKCPECGKSFSDPGHLVRHQRTHTGEKPYKCPECGKSFSQSGNLTEHQRTHTGEKPYKCPECGKSFSQSSSLVRHQRTHTGEKPYKCPECGKSFSHKNALQNHQRTHTGEKPTGKKTS

SEQ ID NO: 1916 - protein, 209 aa, Artificial Sequence
  source: /note="Description of Artificial Sequence: Synthetic polypeptide"
LEPGEKPYKCPECGKSFSDPGNLVRHQRTHTGEKPYKCPECGKSFSTSGNLTEHQRTHTGEKPYKCPECGKSFSTSGNLTEHQRTHTGEKPYKCPECGKSFSRSDHLTNHQRTHTGEKPYKCPECGKSFSDPGHLVRHQRTHTGEKPYKCPECGKSFSQSGNLTEHQRTHTGEKPYKCPECGKSFSQSSSLVRHQRTHTGEKPTGKKTS

SEQ ID NO: 1917 - protein, 209 aa, Artificial Sequence
  source: /note="Description of Artificial Sequence: Synthetic polypeptide"
LEPGEKPYKCPECGKSFSQSGDLRRHQRTHTGEKPYKCPECGKSFSRADNLTEHQRTHTGEKPYKCPECGKSFSHRTTLTNHQRTHTGEKPYKCPECGKSFSTSHSLTEHQRTHTGEKPYKCPECGKSFSDKKDLTRHQRTHTGEKPYKCPECGKSFSDPGALVRHQRTHTGEKPYKCPECGKSFSHKNALQNHQRTHTGEKPTGKKTS

SEQ ID NO: 1918 - protein, 209 aa, Artificial Sequence
  source: /note="Description of Artificial Sequence: Synthetic polypeptide"
LEPGEKPYKCPECGKSFSRADNLTEHQRTHTGEKPYKCPECGKSFSHRTTLTNHQRTHTGEKPYKCPECGKSFSTSHSLTEHQRTHTGEKPYKCPECGKSFSDKKDLTRHQRTHTGEKPYKCPECGKSFSDPGALVRHQRTHTGEKPYKCPECGKSFSHKNALQNHQRTHTGEKPYKCPECGKSFSDCRDLARHQRTHTGEKPTGKKTS

SEQ ID NO: 1919 - protein, 209 aa, Artificial Sequence
  source: /note="Description of Artificial Sequence: Synthetic polypeptide"
LEPGEKPYKCPECGKSFSHRTTLTNHQRTHTGEKPYKCPECGKSFSTSHSLTEHQRTHTGEKPYKCPECGKSFSDKKDLTRHQRTHTGEKPYKCPECGKSFSDPGALVRHQRTHTGEKPYKCPECGKSFSHKNALQNHQRTHTGEKPYKCPECGKSFSDCRDLARHQRTHTGEKPYKCPECGKSFSQSGNLTEHQRTHTGEKPTGKKTS

SEQ ID NO: 1920 - protein, 209 aa, Artificial Sequence
  source: /note="Description of Artificial Sequence: Synthetic polypeptide"
LEPGEKPYKCPECGKSFSRNDTLTEHQRTHTGEKPYKCPECGKSFSTKNSLTEHQRTHTGEKPYKCPECGKSFSQNSTLTEHQRTHTGEKPYKCPECGKSFSERSHLREHQRTHTGEKPYKCPECGKSFSDPGNLVRHQRTHTGEKPYKCPECGKSFSTHLDLIRHQRTHTGEKPYKCPECGKSFSDPGHLVRHQRTHTGEKPTGKKTS

SEQ ID NO: 1921 - protein, 209 aa, Artificial Sequence
  source: /note="Description of Artificial Sequence: Synthetic polypeptide"
LEPGEKPYKCPECGKSFSQLAHLRAHQRTHTGEKPYKCPECGKSFSRNDTLTEHQRTHTGEKPYKCPECGKSFSTKNSLTEHQRTHTGEKPYKCPECGKSFSQNSTLTEHQRTHTGEKPYKCPECGKSFSERSHLREHQRTHTGEKPYKCPECGKSFSDPGNLVRHQRTHTGEKPYKCPECGKSFSTHLDLIRHQRTHTGEKPTGKKTS

SEQ ID NO: 1922 - protein, 209 aa, Artificial Sequence
  source: /note="Description of Artificial Sequence: Synthetic polypeptide"
LEPGEKPYKCPECGKSFSSKKHLAEHQRTHTGEKPYKCPECGKSFSQNSTLTEHQRTHTGEKPYKCPECGKSFSTTGALTEHQRTHTGEKPYKCPECGKSFSQAGHLASHQRTHTGEKPYKCPECGKSFSTSGNLTEHQRTHTGEKPYKCPECGKSFSTTGNLTVHQRTHTGEKPYKCPECGKSFSTSHSLTEHQRTHTGEKPTGKKTS

SEQ ID NO: 1923 - protein, 209 aa, Artificial Sequence
  source: /note="Description of Artificial Sequence: Synthetic polypeptide"
LEPGEKPYKCPECGKSFSTSGNLTEHQRTHTGEKPYKCPECGKSFSSKKHLAEHQRTHTGEKPYKCPECGKSFSRNDALTEHQRTHTGEKPYKCPECGKSFSRSDHLTNHQRTHTGEKPYKCPECGKSFSQKSSLIAHQRTHTGEKPYKCPECGKSFSRSDNLVRHQRTHTGEKPYKCPECGKSFSQSGDLRRHQRTHTGEKPTGKKTS

SEQ ID NO: 1924 - protein, 209 aa, Artificial Sequence
  source: /note="Description of Artificial Sequence: Synthetic polypeptide"
LEPGEKPYKCPECGKSFSDPGHLVRHQRTHTGEKPYKCPECGKSFSTSGNLTEHQRTHTGEKPYKCPECGKSFSSKKHLAEHQRTHTGEKPYKCPECGKSFSRNDALTEHQRTHTGEKPYKCPECGKSFSRSDHLTNHQRTHTGEKPYKCPECGKSFSQKSSLIAHQRTHTGEKPYKCPECGKSFSRSDNLVRHQRTHTGEKPTGKKTS

SEQ ID NO: 1925 - protein, 209 aa, Artificial Sequence
  source: /note="Description of Artificial Sequence: Synthetic polypeptide"
LEPGEKPYKCPECGKSFSTSHSLTEHQRTHTGEKPYKCPECGKSFSDPGHLVRHQRTHTGEKPYKCPECGKSFSTSGNLTEHQRTHTGEKPYKCPECGKSFSSKKHLAEHQRTHTGEKPYKCPECGKSFSRNDALTEHQRTHTGEKPYKCPECGKSFSRSDHLTNHQRTHTGEKPYKCPECGKSFSQKSSLIAHQRTHTGEKPTGKKTS

SEQ ID NO: 1926 - protein, 209 aa, Artificial Sequence
  source: /note="Description of Artificial Sequence: Synthetic polypeptide"
LEPGEKPYKCPECGKSFSQSGHLTEHQRTHTGEKPYKCPECGKSFSTSHSLTEHQRTHTGEKPYKCPECGKSFSDPGHLVRHQRTHTGEKPYKCPECGKSFSTSGNLTEHQRTHTGEKPYKCPECGKSFSSKKHLAEHQRTHTGEKPYKCPECGKSFSRNDALTEHQRTHTGEKPYKCPECGKSFSRSDHLTNHQRTHTGEKPTGKKTS

SEQ ID NO: 1927 - protein, 209 aa, Artificial Sequence
  source: /note="Description of Artificial Sequence: Synthetic polypeptide"
LEPGEKPYKCPECGKSFSRSDHLTTHQRTHTGEKPYKCPECGKSFSTSHSLTEHQRTHTGEKPYKCPECGKSFSDCRDLARHQRTHTGEKPYKCPECGKSFSTSGELVRHQRTHTGEKPYKCPECGKSFSRKDNLKNHQRTHTGEKPYKCPECGKSFSTSGNLVRHQRTHTGEKPYKCPECGKSFSQLAHLRAHQRTHTGEKPTGKKTS

SEQ ID NO: 1928 - protein, 209 aa, Artificial Sequence
  source: /note="Description of Artificial Sequence: Synthetic polypeptide"
LEPGEKPYKCPECGKSFSQRANLRAHQRTHTGEKPYKCPECGKSFSTKNSLTEHQRTHTGEKPYKCPECGKSFSQRANLRAHQRTHTGEKPYKCPECGKSFSREDNLHTHQRTHTGEKPYKCPECGKSFSHKNALQNHQRTHTGEKPYKCPECGKSFSRTDTLRDHQRTHTGEKPYKCPECGKSFSSKKHLAEHQRTHTGEKPTGKKTS

SEQ ID NO: 1929 - protein, 209 aa, Artificial Sequence
  source: /note="Description of Artificial Sequence: Synthetic polypeptide"
LEPGEKPYKCPECGKSFSTKNSLTEHQRTHTGEKPYKCPECGKSFSQRANLRAHQRTHTGEKPYKCPECGKSFSREDNLHTHQRTHTGEKPYKCPECGKSFSHKNALQNHQRTHTGEKPYKCPECGKSFSRTDTLRDHQRTHTGEKPYKCPECGKSFSSKKHLAEHQRTHTGEKPYKCPECGKSFSRSDHLTTHQRTHTGEKPTGKKTS

SEQ ID NO: 1930 - protein, 209 aa, Artificial Sequence
  source: /note="Description of Artificial Sequence: Synthetic polypeptide"
LEPGEKPYKCPECGKSFSQRANLRAHQRTHTGEKPYKCPECGKSFSREDNLHTHQRTHTGEKPYKCPECGKSFSHKNALQNHQRTHTGEKPYKCPECGKSFSRTDTLRDHQRTHTGEKPYKCPECGKSFSSKKHLAEHQRTHTGEKPYKCPECGKSFSRSDHLTTHQRTHTGEKPYKCPECGKSFSTSHSLTEHQRTHTGEKPTGKKTS

SEQ ID NO: 1931 - protein, 209 aa, Artificial Sequence
  source: /note="Description of Artificial Sequence: Synthetic polypeptide"
LEPGEKPYKCPECGKSFSREDNLHTHQRTHTGEKPYKCPECGKSFSHKNALQNHQRTHTGEKPYKCPECGKSFSRTDTLRDHQRTHTGEKPYKCPECGKSFSSKKHLAEHQRTHTGEKPYKCPECGKSFSRSDHLTTHQRTHTGEKPYKCPECGKSFSTSHSLTEHQRTHTGEKPYKCPECGKSFSDCRDLARHQRTHTGEKPTGKKTS

SEQ ID NO: 1932 - protein, 209 aa, Artificial Sequence
  source: /note="Description of Artificial Sequence: Synthetic polypeptide"
LEPGEKPYKCPECGKSFSSKKHLAEHQRTHTGEKPYKCPECGKSFSRSDHLTTHQRTHTGEKPYKCPECGKSFSTSHSLTEHQRTHTGEKPYKCPECGKSFSDCRDLARHQRTHTGEKPYKCPECGKSFSTSGELVRHQRTHTGEKPYKCPECGKSFSRKDNLKNHQRTHTGEKPYKCPECGKSFSTSGNLVRHQRTHTGEKPTGKKTS

SEQ ID NO: 1933 - protein, 209 aa, Artificial Sequence
  source: /note="Description of Artificial Sequence: Synthetic polypeptide"
LEPGEKPYKCPECGKSFSHKNALQNHQRTHTGEKPYKCPECGKSFSRTDTLRDHQRTHTGEKPYKCPECGKSFSSKKHLAEHQRTHTGEKPYKCPECGKSFSRSDHLTTHQRTHTGEKPYKCPECGKSFSTSHSLTEHQRTHTGEKPYKCPECGKSFSDCRDLARHQRTHTGEKPYKCPECGKSFSTSGELVRHQRTHTGEKPTGKKTS

SEQ ID NO: 1934 - protein, 209 aa, Artificial Sequence
  source: /note="Description of Artificial Sequence: Synthetic polypeptide"
LEPGEKPYKCPECGKSFSRTDTLRDHQRTHTGEKPYKCPECGKSFSSKKHLAEHQRTHTGEKPYKCPECGKSFSRSDHLTTHQRTHTGEKPYKCPECGKSFSTSHSLTEHQRTHTGEKPYKCPECGKSFSDCRDLARHQRTHTGEKPYKCPECGKSFSTSGELVRHQRTHTGEKPYKCPECGKSFSRKDNLKNHQRTHTGEKPTGKKTS

SEQ ID NO: 1935 - protein, 209 aa, Artificial Sequence
  source: /note="Description of Artificial Sequence: Synthetic polypeptide"
LEPGEKPYKCPECGKSFSSKKHLAEHQRTHTGEKPYKCPECGKSFSRSDHLTNHQRTHTGEKPYKCPECGKSFSSKKHLAEHQRTHTGEKPYKCPECGKSFSTTGNLTVHQRTHTGEKPYKCPECGKSFSQNSTLTEHQRTHTGEKPYKCPECGKSFSDSGNLRVHQRTHTGEKPYKCPECGKSFSQLAHLRAHQRTHTGEKPTGKKTS

SEQ ID NO: 1936 - protein, 209 aa, Artificial Sequence
  source: /note="Description of Artificial Sequence: Synthetic polypeptide"
LEPGEKPYKCPECGKSFSRADNLTEHQRTHTGEKPYKCPECGKSFSSKKHLAEHQRTHTGEKPYKCPECGKSFSRSDHLTNHQRTHTGEKPYKCPECGKSFSSKKHLAEHQRTHTGEKPYKCPECGKSFSTTGNLTVHQRTHTGEKPYKCPECGKSFSQNSTLTEHQRTHTGEKPYKCPECGKSFSDSGNLRVHQRTHTGEKPTGKKTS

SEQ ID NO: 1937 - protein, 209 aa, Artificial Sequence
  source: /note="Description of Artificial Sequence: Synthetic polypeptide"
LEPGEKPYKCPECGKSFSRRDELNVHQRTHTGEKPYKCPECGKSFSRADNLTEHQRTHTGEKPYKCPECGKSFSSKKHLAEHQRTHTGEKPYKCPECGKSFSRSDHLTNHQRTHTGEKPYKCPECGKSFSSKKHLAEHQRTHTGEKPYKCPECGKSFSTTGNLTVHQRTHTGEKPYKCPECGKSFSQNSTLTEHQRTHTGEKPTGKKTS

SEQ ID NO: 1938 - protein, 209 aa, Artificial Sequence
  source: /note="Description of Artificial Sequence: Synthetic polypeptide"
LEPGEKPYKCPECGKSFSTSHSLTEHQRTHTGEKPYKCPECGKSFSRRDELNVHQRTHTGEKPYKCPECGKSFSRADNLTEHQRTHTGEKPYKCPECGKSFSSKKHLAEHQRTHTGEKPYKCPECGKSFSRSDHLTNHQRTHTGEKPYKCPECGKSFSSKKHLAEHQRTHTGEKPYKCPECGKSFSTTGNLTVHQRTHTGEKPTGKKTS

SEQ ID NO: 1939 - protein, 209 aa, Artificial Sequence
  source: /note="Description of Artificial Sequence: Synthetic polypeptide"
LEPGEKPYKCPECGKSFSTTGALTEHQRTHTGEKPYKCPECGKSFSTTGNLTVHQRTHTGEKPYKCPECGKSFSDCRDLARHQRTHTGEKPYKCPECGKSFSTSGNLVRHQRTHTGEKPYKCPECGKSFSTSHSLTEHQRTHTGEKPYKCPECGKSFSDCRDLARHQRTHTGEKPYKCPECGKSFSRADNLTEHQRTHTGEKPTGKKTS

SEQ ID NO: 1940 - protein, 209 aa, Artificial Sequence
  source: /note="Description of Artificial Sequence: Synthetic polypeptide"
LEPGEKPYKCPECGKSFSTKNSLTEHQRTHTGEKPYKCPECGKSFSTSGNLVRHQRTHTGEKPYKCPECGKSFSRNDALTEHQRTHTGEKPYKCPECGKSFSTTGALTEHQRTHTGEKPYKCPECGKSFSTTGNLTVHQRTHTGEKPYKCPECGKSFSDCRDLARHQRTHTGEKPYKCPECGKSFSTSGNLVRHQRTHTGEKPTGKKTS

SEQ ID NO: 1941 - protein, 209 aa, Artificial Sequence
  source: /note="Description of Artificial Sequence: Synthetic polypeptide"
LEPGEKPYKCPECGKSFSRNDALTEHQRTHTGEKPYKCPECGKSFSTTGALTEHQRTHTGEKPYKCPECGKSFSTTGNLTVHQRTHTGEKPYKCPECGKSFSDCRDLARHQRTHTGEKPYKCPECGKSFSTSGNLVRHQRTHTGEKPYKCPECGKSFSTSHSLTEHQRTHTGEKPYKCPECGKSFSDCRDLARHQRTHTGEKPTGKKTS

SEQ ID NO: 1942 - protein, 209 aa, Artificial Sequence
  source: /note="Description of Artificial Sequence: Synthetic polypeptide"
LEPGEKPYKCPECGKSFSTSGNLVRHQRTHTGEKPYKCPECGKSFSRNDALTEHQRTHTGEKPYKCPECGKSFSTTGALTEHQRTHTGEKPYKCPECGKSFSTTGNLTVHQRTHTGEKPYKCPECGKSFSDCRDLARHQRTHTGEKPYKCPECGKSFSTSGNLVRHQRTHTGEKPYKCPECGKSFSTSHSLTEHQRTHTGEKPTGKKTS

SEQ ID NO: 1943 - protein, 209 aa, Artificial Sequence
  source: /note="Description of Artificial Sequence: Synthetic polypeptide"
LEPGEKPYKCPECGKSFSQRAHLERHQRTHTGEKPYKCPECGKSFSTHLDLIRHQRTHTGEKPYKCPECGKSFSRSDHLTTHQRTHTGEKPYKCPECGKSFSQSSNLVRHQRTHTGEKPYKCPECGKSFSQSGDLRRHQRTHTGEKPYKCPECGKSFSQRAHLERHQRTHTGEKPYKCPECGKSFSRNDALTEHQRTHTGEKPTGKKTS

SEQ ID NO: 1944 - protein, 209 aa, Artificial Sequence
  source: /note="Description of Artificial Sequence: Synthetic polypeptide"
LEPGEKPYKCPECGKSFSTHLDLIRHQRTHTGEKPYKCPECGKSFSRSDHLTTHQRTHTGEKPYKCPECGKSFSQSSNLVRHQRTHTGEKPYKCPECGKSFSQSGDLRRHQRTHTGEKPYKCPECGKSFSQRAHLERHQRTHTGEKPYKCPECGKSFSRNDALTEHQRTHTGEKPYKCPECGKSFSSKKHLAEHQRTHTGEKPTGKKTS

SEQ ID NO: 1945 - protein, 209 aa, Artificial Sequence
  source: /note="Description of Artificial Sequence: Synthetic polypeptide"
LEPGEKPYKCPECGKSFSHRTTLTNHQRTHTGEKPYKCPECGKSFSQRAHLERHQRTHTGEKPYKCPECGKSFSTHLDLIRHQRTHTGEKPYKCPECGKSFSRSDHLTTHQRTHTGEKPYKCPECGKSFSQSSNLVRHQRTHTGEKPYKCPECGKSFSQSGDLRRHQRTHTGEKPYKCPECGKSFSQRAHLERHQRTHTGEKPTGKKTS

SEQ ID NO: 1946 - protein, 209 aa, Artificial Sequence
  source: /note="Description of Artificial Sequence: Synthetic polypeptide"
LEPGEKPYKCPECGKSFSRSDHLTTHQRTHTGEKPYKCPECGKSFSQSSNLVRHQRTHTGEKPYKCPECGKSFSQSGDLRRHQRTHTGEKPYKCPECGKSFSQRAHLERHQRTHTGEKPYKCPECGKSFSRNDALTEHQRTHTGEKPYKCPECGKSFSSKKHLAEHQRTHTGEKPYKCPECGKSFSTSGSLVRHQRTHTGEKPTGKKTS

SEQ ID NO: 1947 - protein, 209 aa, Artificial Sequence
  source: /note="Description of Artificial Sequence: Synthetic polypeptide"
LEPGEKPYKCPECGKSFSQSSNLVRHQRTHTGEKPYKCPECGKSFSQSGDLRRHQRTHTGEKPYKCPECGKSFSQRAHLERHQRTHTGEKPYKCPECGKSFSRNDALTEHQRTHTGEKPYKCPECGKSFSSKKHLAEHQRTHTGEKPYKCPECGKSFSTSGSLVRHQRTHTGEKPYKCPECGKSFSRNDTLTEHQRTHTGEKPTGKKTS

SEQ ID NO: 1948 - protein, 209 aa, Artificial Sequence
  source: /note="Description of Artificial Sequence: Synthetic polypeptide"
LEPGEKPYKCPECGKSFSQSSNLVRHQRTHTGEKPYKCPECGKSFSRNDALTEHQRTHTGEKPYKCPECGKSFSQRAHLERHQRTHTGEKPYKCPECGKSFSTTGNLTVHQRTHTGEKPYKCPECGKSFSRADNLTEHQRTHTGEKPYKCPECGKSFSRSDNLVRHQRTHTGEKPYKCPECGKSFSRSDHLTTHQRTHTGEKPTGKKTS

SEQ ID NO: 1949 - protein, 209 aa, Artificial Sequence
  source: /note="Description of Artificial Sequence: Synthetic polypeptide"
LEPGEKPYKCPECGKSFSRNDALTEHQRTHTGEKPYKCPECGKSFSQRAHLERHQRTHTGEKPYKCPECGKSFSTTGNLTVHQRTHTGEKPYKCPECGKSFSRADNLTEHQRTHTGEKPYKCPECGKSFSRSDNLVRHQRTHTGEKPYKCPECGKSFSRSDHLTTHQRTHTGEKPYKCPECGKSFSSKKHLAEHQRTHTGEKPTGKKTS

SEQ ID NO: 1950 - protein, 209 aa, Artificial Sequence
  source: /note="Description of Artificial Sequence: Synthetic polypeptide"
LEPGEKPYKCPECGKSFSRADNLTEHQRTHTGEKPYKCPECGKSFSDPGHLVRHQRTHTGEKPYKCPECGKSFSRSDNLVRHQRTHTGEKPYKCPECGKSFSRSDHLTTHQRTHTGEKPYKCPECGKSFSTSGSLVRHQRTHTGEKPYKCPECGKSFSQSSNLVRHQRTHTGEKPYKCPECGKSFSRNDALTEHQRTHTGEKPTGKKTS

SEQ ID NO: 1951 - protein, 209 aa, Artificial Sequence
  source: /note="Description of Artificial Sequence: Synthetic polypeptide"
LEPGEKPYKCPECGKSFSHKNALQNHQRTHTGEKPYKCPECGKSFSRADNLTEHQRTHTGEKPYKCPECGKSFSDPGHLVRHQRTHTGEKPYKCPECGKSFSRSDNLVRHQRTHTGEKPYKCPECGKSFSRSDHLTTHQRTHTGEKPYKCPECGKSFSTSGSLVRHQRTHTGEKPYKCPECGKSFSQSSNLVRHQRTHTGEKPTGKKTS

SEQ ID NO: 1952 - protein, 209 aa, Artificial Sequence
  source: /note="Description of Artificial Sequence: Synthetic polypeptide"
LEPGEKPYKCPECGKSFSSKKALTEHQRTHTGEKPYKCPECGKSFSHKNALQNHQRTHTGEKPYKCPECGKSFSRADNLTEHQRTHTGEKPYKCPECGKSFSDPGHLVRHQRTHTGEKPYKCPECGKSFSRSDNLVRHQRTHTGEKPYKCPECGKSFSRSDHLTTHQRTHTGEKPYKCPECGKSFSTSGSLVRHQRTHTGEKPTGKKTS

SEQ ID NO: 1953 - protein, 209 aa, Artificial Sequence
  source: /note="Description of Artificial Sequence: Synthetic polypeptide"
LEPGEKPYKCPECGKSFSTSGSLVRHQRTHTGEKPYKCPECGKSFSQSSNLVRHQRTHTGEKPYKCPECGKSFSRNDALTEHQRTHTGEKPYKCPECGKSFSQRAHLERHQRTHTGEKPYKCPECGKSFSTTGNLTVHQRTHTGEKPYKCPECGKSFSRADNLTEHQRTHTGEKPYKCPECGKSFSRSDNLVRHQRTHTGEKPTGKKTS

SEQ ID NO: 1954 - protein, 209 aa, Artificial Sequence
  source: /note="Description of Artificial Sequence: Synthetic polypeptide"
LEPGEKPYKCPECGKSFSRSDNLVRHQRTHTGEKPYKCPECGKSFSRSDHLTTHQRTHTGEKPYKCPECGKSFSTSGSLVRHQRTHTGEKPYKCPECGKSFSQSSNLVRHQRTHTGEKPYKCPECGKSFSRNDALTEHQRTHTGEKPYKCPECGKSFSQRAHLERHQRTHTGEKPYKCPECGKSFSTTGNLTVHQRTHTGEKPTGKKTS

SEQ ID NO: 1955 - protein, 209 aa, Artificial Sequence
  source: /note="Description of Artificial Sequence: Synthetic polypeptide"
LEPGEKPYKCPECGKSFSDPGHLVRHQRTHTGEKPYKCPECGKSFSRSDNLVRHQRTHTGEKPYKCPECGKSFSRSDHLTTHQRTHTGEKPYKCPECGKSFSTSGSLVRHQRTHTGEKPYKCPECGKSFSQSSNLVRHQRTHTGEKPYKCPECGKSFSRNDALTEHQRTHTGEKPYKCPECGKSFSQRAHLERHQRTHTGEKPTGKKTS

SEQ ID NO: 1956 - protein, 209 aa, Artificial Sequence
  source: /note="Description of Artificial Sequence: Synthetic polypeptide"
LEPGEKPYKCPECGKSFSRSDHLTTHQRTHTGEKPYKCPECGKSFSTSGSLVRHQRTHTGEKPYKCPECGKSFSQSSNLVRHQRTHTGEKPYKCPECGKSFSRNDALTEHQRTHTGEKPYKCPECGKSFSQRAHLERHQRTHTGEKPYKCPECGKSFSTTGNLTVHQRTHTGEKPYKCPECGKSFSRADNLTEHQRTHTGEKPTGKKTS

SEQ ID NO: 1957 - protein, 209 aa, Artificial Sequence
  source: /note="Description of Artificial Sequence: Synthetic polypeptide"
LEPGEKPYKCPECGKSFSRSDHLTTHQRTHTGEKPYKCPECGKSFSDPGNLVRHQRTHTGEKPYKCPECGKSFSRRDELNVHQRTHTGEKPYKCPECGKSFSQLAHLRAHQRTHTGEKPYKCPECGKSFSERSHLREHQRTHTGEKPYKCPECGKSFSRSDKLVRHQRTHTGEKPYKCPECGKSFSTKNSLTEHQRTHTGEKPTGKKTS

SEQ ID NO: 1958 - protein, 209 aa, Artificial Sequence
  source: /note="Description of Artificial Sequence: Synthetic polypeptide"
LEPGEKPYKCPECGKSFSRKDNLKNHQRTHTGEKPYKCPECGKSFSRSDHLTTHQRTHTGEKPYKCPECGKSFSDPGNLVRHQRTHTGEKPYKCPECGKSFSRRDELNVHQRTHTGEKPYKCPECGKSFSQLAHLRAHQRTHTGEKPYKCPECGKSFSERSHLREHQRTHTGEKPYKCPECGKSFSRSDKLVRHQRTHTGEKPTGKKTS

SEQ ID NO: 1959 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSHSLTEHXXXHXXXXXXXCXXCXXXXXRSDKLVRHXXXHXXXXXXXCXXCXXXXXTKNSLTEHXXXHXXXXXXXCXXCXXXXXRADNLTEHXXXHXXXXXXXCXXCXXXXXERSHLREHXXXHXXXXXXXCXXCXXXXXRSDHLTTHXXXHXXXXXXXCXXCXXXXXQLAHLRAHXXXHXXXXXXXXXXX

SEQ ID NO: 1960 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRNDALTEHXXXHXXXXXXXCXXCXXXXXSPADLTRHXXXHXXXXXXXCXXCXXXXXQSSNLVRHXXXHXXXXXXXCXXCXXXXXTSHSLTEHXXXHXXXXXXXCXXCXXXXXRSDKLVRHXXXHXXXXXXXCXXCXXXXXTKNSLTEHXXXHXXXXXXXCXXCXXXXXRADNLTEHXXXHXXXXXXXXXXX

SEQ ID NO: 1961 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSPADLTRHXXXHXXXXXXXCXXCXXXXXQSSNLVRHXXXHXXXXXXXCXXCXXXXXTSHSLTEHXXXHXXXXXXXCXXCXXXXXRSDKLVRHXXXHXXXXXXXCXXCXXXXXTKNSLTEHXXXHXXXXXXXCXXCXXXXXRADNLTEHXXXHXXXXXXXCXXCXXXXXERSHLREHXXXHXXXXXXXXXXX

SEQ ID NO: 1962 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSSNLVRHXXXHXXXXXXXCXXCXXXXXTSHSLTEHXXXHXXXXXXXCXXCXXXXXRSDKLVRHXXXHXXXXXXXCXXCXXXXXTKNSLTEHXXXHXXXXXXXCXXCXXXXXRADNLTEHXXXHXXXXXXXCXXCXXXXXERSHLREHXXXHXXXXXXXCXXCXXXXXRSDHLTTHXXXHXXXXXXXXXXX

SEQ ID NO: 1963 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXTKNSLTEHXXXHXXXXXXXCXXCXXXXXRADNLTEHXXXHXXXXXXXCXXCXXXXXERSHLREHXXXHXXXXXXXCXXCXXXXXRSDHLTTHXXXHXXXXXXXCXXCXXXXXQLAHLRAHXXXHXXXXXXXCXXCXXXXXRNDTLTEHXXXHXXXXXXXXXXX

SEQ ID NO: 1964 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTKNSLTEHXXXHXXXXXXXCXXCXXXXXRADNLTEHXXXHXXXXXXXCXXCXXXXXERSHLREHXXXHXXXXXXXCXXCXXXXXRSDHLTTHXXXHXXXXXXXCXXCXXXXXQLAHLRAHXXXHXXXXXXXCXXCXXXXXRNDTLTEHXXXHXXXXXXXCXXCXXXXXTTGNLTVHXXXHXXXXXXXXXXX

SEQ ID NO: 1965 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTTGNLTVHXXXHXXXXXXXCXXCXXXXXQSSNLVRHXXXHXXXXXXXCXXCXXXXXRSDHLTTHXXXHXXXXXXXCXXCXXXXXQAGHLASHXXXHXXXXXXXCXXCXXXXXRRDELNVHXXXHXXXXXXXCXXCXXXXXQLAHLRAHXXXHXXXXXXXCXXCXXXXXRSDHLTNHXXXHXXXXXXXXXXX

SEQ ID NO: 1966 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSSNLVRHXXXHXXXXXXXCXXCXXXXXRSDHLTTHXXXHXXXXXXXCXXCXXXXXQAGHLASHXXXHXXXXXXXCXXCXXXXXRRDELNVHXXXHXXXXXXXCXXCXXXXXQLAHLRAHXXXHXXXXXXXCXXCXXXXXRSDHLTNHXXXHXXXXXXXCXXCXXXXXDSGNLRVHXXXHXXXXXXXXXXX

SEQ ID NO: 1967 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTTHXXXHXXXXXXXCXXCXXXXXQLAHLRAHXXXHXXXXXXXCXXCXXXXXRNDTLTEHXXXHXXXXXXXCXXCXXXXXTTGNLTVHXXXHXXXXXXXCXXCXXXXXQSSNLVRHXXXHXXXXXXXCXXCXXXXXRSDHLTTHXXXHXXXXXXXCXXCXXXXXQAGHLASHXXXHXXXXXXXXXXX

SEQ ID NO: 1968 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRADNLTEHXXXHXXXXXXXCXXCXXXXXERSHLREHXXXHXXXXXXXCXXCXXXXXRSDHLTTHXXXHXXXXXXXCXXCXXXXXQLAHLRAHXXXHXXXXXXXCXXCXXXXXRNDTLTEHXXXHXXXXXXXCXXCXXXXXTTGNLTVHXXXHXXXXXXXCXXCXXXXXQSSNLVRHXXXHXXXXXXXXXXX

SEQ ID NO: 1969 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXERSHLREHXXXHXXXXXXXCXXCXXXXXRSDHLTTHXXXHXXXXXXXCXXCXXXXXQLAHLRAHXXXHXXXXXXXCXXCXXXXXRNDTLTEHXXXHXXXXXXXCXXCXXXXXTTGNLTVHXXXHXXXXXXXCXXCXXXXXQSSNLVRHXXXHXXXXXXXCXXCXXXXXRSDHLTTHXXXHXXXXXXXXXXX

SEQ ID NO: 1970 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQRAHLERHXXXHXXXXXXXCXXCXXXXXRNDALTEHXXXHXXXXXXXCXXCXXXXXSPADLTRHXXXHXXXXXXXCXXCXXXXXQSSNLVRHXXXHXXXXXXXCXXCXXXXXTSHSLTEHXXXHXXXXXXXCXXCXXXXXRSDKLVRHXXXHXXXXXXXCXXCXXXXXTKNSLTEHXXXHXXXXXXXXXXX

SEQ ID NO: 1971 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDELVRHXXXHXXXXXXXCXXCXXXXXTSGELVRHXXXHXXXXXXXCXXCXXXXXQRAHLERHXXXHXXXXXXXCXXCXXXXXRNDALTEHXXXHXXXXXXXCXXCXXXXXSPADLTRHXXXHXXXXXXXCXXCXXXXXQSSNLVRHXXXHXXXXXXXCXXCXXXXXTSHSLTEHXXXHXXXXXXXXXXX

SEQ ID NO: 1972 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGELVRHXXXHXXXXXXXCXXCXXXXXQRAHLERHXXXHXXXXXXXCXXCXXXXXRNDALTEHXXXHXXXXXXXCXXCXXXXXSPADLTRHXXXHXXXXXXXCXXCXXXXXQSSNLVRHXXXHXXXXXXXCXXCXXXXXTSHSLTEHXXXHXXXXXXXCXXCXXXXXRSDKLVRHXXXHXXXXXXXXXXX

SEQ ID NO: 1973 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQAGHLASHXXXHXXXXXXXCXXCXXXXXRRDELNVHXXXHXXXXXXXCXXCXXXXXQLAHLRAHXXXHXXXXXXXCXXCXXXXXRSDHLTNHXXXHXXXXXXXCXXCXXXXXDSGNLRVHXXXHXXXXXXXCXXCXXXXXQRAHLERHXXXHXXXXXXXCXXCXXXXXRSDNLVRHXXXHXXXXXXXXXXX

SEQ ID NO: 1974 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTTHXXXHXXXXXXXCXXCXXXXXQAGHLASHXXXHXXXXXXXCXXCXXXXXRRDELNVHXXXHXXXXXXXCXXCXXXXXQLAHLRAHXXXHXXXXXXXCXXCXXXXXRSDHLTNHXXXHXXXXXXXCXXCXXXXXDSGNLRVHXXXHXXXXXXXCXXCXXXXXQRAHLERHXXXHXXXXXXXXXXX

SEQ ID NO: 1975 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQLAHLRAHXXXHXXXXXXXCXXCXXXXXRNDTLTEHXXXHXXXXXXXCXXCXXXXXTTGNLTVHXXXHXXXXXXXCXXCXXXXXQSSNLVRHXXXHXXXXXXXCXXCXXXXXRSDHLTTHXXXHXXXXXXXCXXCXXXXXQAGHLASHXXXHXXXXXXXCXXCXXXXXRRDELNVHXXXHXXXXXXXXXXX

SEQ ID NO: 1976 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRNDTLTEHXXXHXXXXXXXCXXCXXXXXTTGNLTVHXXXHXXXXXXXCXXCXXXXXQSSNLVRHXXXHXXXXXXXCXXCXXXXXRSDHLTTHXXXHXXXXXXXCXXCXXXXXQAGHLASHXXXHXXXXXXXCXXCXXXXXRRDELNVHXXXHXXXXXXXCXXCXXXXXQLAHLRAHXXXHXXXXXXXXXXX

SEQ ID NO: 1977 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQRAHLERHXXXHXXXXXXXCXXCXXXXXRSDELVRHXXXHXXXXXXXCXXCXXXXXTSGELVRHXXXHXXXXXXXCXXCXXXXXQRAHLERHXXXHXXXXXXXCXXCXXXXXRNDALTEHXXXHXXXXXXXCXXCXXXXXSPADLTRHXXXHXXXXXXXCXXCXXXXXQSSNLVRHXXXHXXXXXXXXXXX

SEQ ID NO: 1978 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRADNLTEHXXXHXXXXXXXCXXCXXXXXRSDKLVRHXXXHXXXXXXXCXXCXXXXXRSDNLVRHXXXHXXXXXXXCXXCXXXXXQRAHLERHXXXHXXXXXXXCXXCXXXXXDPGNLVRHXXXHXXXXXXXCXXCXXXXXQRAHLERHXXXHXXXXXXXCXXCXXXXXRSDELVRHXXXHXXXXXXXXXXX

SEQ ID NO: 1979 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGNLVRHXXXHXXXXXXXCXXCXXXXXQRAHLERHXXXHXXXXXXXCXXCXXXXXRSDELVRHXXXHXXXXXXXCXXCXXXXXTSGELVRHXXXHXXXXXXXCXXCXXXXXQRAHLERHXXXHXXXXXXXCXXCXXXXXRNDALTEHXXXHXXXXXXXCXXCXXXXXSPADLTRHXXXHXXXXXXXXXXX

SEQ ID NO: 1980 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXRSDNLVRHXXXHXXXXXXXCXXCXXXXXQRAHLERHXXXHXXXXXXXCXXCXXXXXDPGNLVRHXXXHXXXXXXXCXXCXXXXXQRAHLERHXXXHXXXXXXXCXXCXXXXXRSDELVRHXXXHXXXXXXXCXXCXXXXXTSGELVRHXXXHXXXXXXXXXXX

SEQ ID NO: 1981 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQRAHLERHXXXHXXXXXXXCXXCXXXXXDPGNLVRHXXXHXXXXXXXCXXCXXXXXQRAHLERHXXXHXXXXXXXCXXCXXXXXRSDELVRHXXXHXXXXXXXCXXCXXXXXTSGELVRHXXXHXXXXXXXCXXCXXXXXQRAHLERHXXXHXXXXXXXCXXCXXXXXRNDALTEHXXXHXXXXXXXXXXX

SEQ ID NO: 1982 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDNLVRHXXXHXXXXXXXCXXCXXXXXQRAHLERHXXXHXXXXXXXCXXCXXXXXDPGNLVRHXXXHXXXXXXXCXXCXXXXXQRAHLERHXXXHXXXXXXXCXXCXXXXXRSDELVRHXXXHXXXXXXXCXXCXXXXXTSGELVRHXXXHXXXXXXXCXXCXXXXXQRAHLERHXXXHXXXXXXXXXXX

SEQ ID NO: 1983 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQLAHLRAHXXXHXXXXXXXCXXCXXXXXRSDHLTNHXXXHXXXXXXXCXXCXXXXXDSGNLRVHXXXHXXXXXXXCXXCXXXXXQRAHLERHXXXHXXXXXXXCXXCXXXXXRSDNLVRHXXXHXXXXXXXCXXCXXXXXTSGHLVRHXXXHXXXXXXXCXXCXXXXXRSDKLVRHXXXHXXXXXXXXXXX

SEQ ID NO: 1984 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXTSGHLVRHXXXHXXXXXXXCXXCXXXXXRADNLTEHXXXHXXXXXXXCXXCXXXXXRSDKLVRHXXXHXXXXXXXCXXCXXXXXRSDNLVRHXXXHXXXXXXXCXXCXXXXXQRAHLERHXXXHXXXXXXXCXXCXXXXXDPGNLVRHXXXHXXXXXXXXXXX

SEQ ID NO: 1985 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRRDELNVHXXXHXXXXXXXCXXCXXXXXQLAHLRAHXXXHXXXXXXXCXXCXXXXXRSDHLTNHXXXHXXXXXXXCXXCXXXXXDSGNLRVHXXXHXXXXXXXCXXCXXXXXQRAHLERHXXXHXXXXXXXCXXCXXXXXRSDNLVRHXXXHXXXXXXXCXXCXXXXXTSGHLVRHXXXHXXXXXXXXXXX

SEQ ID NO: 1986 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGHLVRHXXXHXXXXXXXCXXCXXXXXRADNLTEHXXXHXXXXXXXCXXCXXXXXRSDKLVRHXXXHXXXXXXXCXXCXXXXXRSDNLVRHXXXHXXXXXXXCXXCXXXXXQRAHLERHXXXHXXXXXXXCXXCXXXXXDPGNLVRHXXXHXXXXXXXCXXCXXXXXQRAHLERHXXXHXXXXXXXXXXX

SEQ ID NO: 1987 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDSGNLRVHXXXHXXXXXXXCXXCXXXXXQRAHLERHXXXHXXXXXXXCXXCXXXXXRSDNLVRHXXXHXXXXXXXCXXCXXXXXTSGHLVRHXXXHXXXXXXXCXXCXXXXXRSDKLVRHXXXHXXXXXXXCXXCXXXXXTSGHLVRHXXXHXXXXXXXCXXCXXXXXRSDKLVRHXXXHXXXXXXXXXXX

SEQ ID NO: 1988 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTNHXXXHXXXXXXXCXXCXXXXXDSGNLRVHXXXHXXXXXXXCXXCXXXXXQRAHLERHXXXHXXXXXXXCXXCXXXXXRSDNLVRHXXXHXXXXXXXCXXCXXXXXTSGHLVRHXXXHXXXXXXXCXXCXXXXXRSDKLVRHXXXHXXXXXXXCXXCXXXXXTSGHLVRHXXXHXXXXXXXXXXX

SEQ ID NO: 1989 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQRAHLERHXXXHXXXXXXXCXXCXXXXXRSDNLVRHXXXHXXXXXXXCXXCXXXXXTSGHLVRHXXXHXXXXXXXCXXCXXXXXRSDKLVRHXXXHXXXXXXXCXXCXXXXXTSGHLVRHXXXHXXXXXXXCXXCXXXXXRSDKLVRHXXXHXXXXXXXCXXCXXXXXQRAHLERHXXXHXXXXXXXXXXX

SEQ ID NO: 1990 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDNLVRHXXXHXXXXXXXCXXCXXXXXTSGHLVRHXXXHXXXXXXXCXXCXXXXXRSDKLVRHXXXHXXXXXXXCXXCXXXXXTSGHLVRHXXXHXXXXXXXCXXCXXXXXRSDKLVRHXXXHXXXXXXXCXXCXXXXXQRAHLERHXXXHXXXXXXXCXXCXXXXXRNDTLTEHXXXHXXXXXXXXXXX

SEQ ID NO: 1991 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTNHXXXHXXXXXXXCXXCXXXXXRSDELVRHXXXHXXXXXXXCXXCXXXXXRSDKLVRHXXXHXXXXXXXCXXCXXXXXRSDELVRHXXXHXXXXXXXCXXCXXXXXRSDKLVRHXXXHXXXXXXXCXXCXXXXXRSDNLVRHXXXHXXXXXXXCXXCXXXXXRSDKLTEHXXXHXXXXXXXXXXX

SEQ ID NO: 1992 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSSNLVRHXXXHXXXXXXXCXXCXXXXXRSDHLTNHXXXHXXXXXXXCXXCXXXXXRSDELVRHXXXHXXXXXXXCXXCXXXXXRSDKLVRHXXXHXXXXXXXCXXCXXXXXRSDELVRHXXXHXXXXXXXCXXCXXXXXRSDKLVRHXXXHXXXXXXXCXXCXXXXXRSDNLVRHXXXHXXXXXXXXXXX

SEQ ID NO: 1993 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSPADLTRHXXXHXXXXXXXCXXCXXXXXQSSNLVRHXXXHXXXXXXXCXXCXXXXXRSDHLTNHXXXHXXXXXXXCXXCXXXXXRSDELVRHXXXHXXXXXXXCXXCXXXXXRSDKLVRHXXXHXXXXXXXCXXCXXXXXRSDELVRHXXXHXXXXXXXCXXCXXXXXRSDKLVRHXXXHXXXXXXXXXXX

SEQ ID NO: 1994 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQRAHLERHXXXHXXXXXXXCXXCXXXXXSPADLTRHXXXHXXXXXXXCXXCXXXXXQSSNLVRHXXXHXXXXXXXCXXCXXXXXRSDHLTNHXXXHXXXXXXXCXXCXXXXXRSDELVRHXXXHXXXXXXXCXXCXXXXXRSDKLVRHXXXHXXXXXXXCXXCXXXXXRSDELVRHXXXHXXXXXXXXXXX

SEQ ID NO: 1995 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSSNLVRHXXXHXXXXXXXCXXCXXXXXQRAHLERHXXXHXXXXXXXCXXCXXXXXSPADLTRHXXXHXXXXXXXCXXCXXXXXQSSNLVRHXXXHXXXXXXXCXXCXXXXXRSDHLTNHXXXHXXXXXXXCXXCXXXXXRSDELVRHXXXHXXXXXXXCXXCXXXXXRSDKLVRHXXXHXXXXXXXXXXX

SEQ ID NO: 1996 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTTGNLTVHXXXHXXXXXXXCXXCXXXXXRSDNLVRHXXXHXXXXXXXCXXCXXXXXRADNLTEHXXXHXXXXXXXCXXCXXXXXQRANLRAHXXXHXXXXXXXCXXCXXXXXRSDKLVRHXXXHXXXXXXXCXXCXXXXXQAGHLASHXXXHXXXXXXXCXXCXXXXXRSDKLVRHXXXHXXXXXXXXXXX

SEQ ID NO: 1997 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRADNLTEHXXXHXXXXXXXCXXCXXXXXQRANLRAHXXXHXXXXXXXCXXCXXXXXRSDKLVRHXXXHXXXXXXXCXXCXXXXXQAGHLASHXXXHXXXXXXXCXXCXXXXXRSDKLVRHXXXHXXXXXXXCXXCXXXXXRSDHLTTHXXXHXXXXXXXCXXCXXXXXRSDKLVRHXXXHXXXXXXXXXXX

SEQ ID NO: 1998 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDELVRHXXXHXXXXXXXCXXCXXXXXTTGNLTVHXXXHXXXXXXXCXXCXXXXXRSDNLVRHXXXHXXXXXXXCXXCXXXXXRADNLTEHXXXHXXXXXXXCXXCXXXXXQRANLRAHXXXHXXXXXXXCXXCXXXXXRSDKLVRHXXXHXXXXXXXCXXCXXXXXQAGHLASHXXXHXXXXXXXXXXX

SEQ ID NO: 1999 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDNLVRHXXXHXXXXXXXCXXCXXXXXRADNLTEHXXXHXXXXXXXCXXCXXXXXQRANLRAHXXXHXXXXXXXCXXCXXXXXRSDKLVRHXXXHXXXXXXXCXXCXXXXXQAGHLASHXXXHXXXXXXXCXXCXXXXXRSDKLVRHXXXHXXXXXXXCXXCXXXXXRSDHLTTHXXXHXXXXXXXXXXX

SEQ ID NO: 2000 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXQAGHLASHXXXHXXXXXXXCXXCXXXXXRSDKLVRHXXXHXXXXXXXCXXCXXXXXRSDHLTTHXXXHXXXXXXXCXXCXXXXXRSDKLVRHXXXHXXXXXXXCXXCXXXXXRSDHLTNHXXXHXXXXXXXCXXCXXXXXRSDKLVRHXXXHXXXXXXXXXXX

SEQ ID NO: 2001 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQRANLRAHXXXHXXXXXXXCXXCXXXXXRSDKLVRHXXXHXXXXXXXCXXCXXXXXQAGHLASHXXXHXXXXXXXCXXCXXXXXRSDKLVRHXXXHXXXXXXXCXXCXXXXXRSDHLTTHXXXHXXXXXXXCXXCXXXXXRSDKLVRHXXXHXXXXXXXCXXCXXXXXRSDHLTNHXXXHXXXXXXXXXXX

SEQ ID NO: 2002 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRRDELNVHXXXHXXXXXXXCXXCXXXXXRSDELVRHXXXHXXXXXXXCXXCXXXXXTTGNLTVHXXXHXXXXXXXCXXCXXXXXRSDNLVRHXXXHXXXXXXXCXXCXXXXXRADNLTEHXXXHXXXXXXXCXXCXXXXXQRANLRAHXXXHXXXXXXXCXXCXXXXXRSDKLVRHXXXHXXXXXXXXXXX

SEQ ID NO: 2003 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQRAHLERHXXXHXXXXXXXCXXCXXXXXRRDELNVHXXXHXXXXXXXCXXCXXXXXRSDELVRHXXXHXXXXXXXCXXCXXXXXTTGNLTVHXXXHXXXXXXXCXXCXXXXXRSDNLVRHXXXHXXXXXXXCXXCXXXXXRADNLTEHXXXHXXXXXXXCXXCXXXXXQRANLRAHXXXHXXXXXXXXXXX

SEQ ID NO: 2004 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQRANLRAHXXXHXXXXXXXCXXCXXXXXQRAHLERHXXXHXXXXXXXCXXCXXXXXRRDELNVHXXXHXXXXXXXCXXCXXXXXRSDELVRHXXXHXXXXXXXCXXCXXXXXTTGNLTVHXXXHXXXXXXXCXXCXXXXXRSDNLVRHXXXHXXXXXXXCXXCXXXXXRADNLTEHXXXHXXXXXXXXXXX

SEQ ID NO: 2005 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRNDALTEHXXXHXXXXXXXCXXCXXXXXRSDNLVRHXXXHXXXXXXXCXXCXXXXXRSDHLTTHXXXHXXXXXXXCXXCXXXXXSKKALTEHXXXHXXXXXXXCXXCXXXXXQRANLRAHXXXHXXXXXXXCXXCXXXXXRADNLTEHXXXHXXXXXXXCXXCXXXXXDPGHLVRHXXXHXXXXXXXXXXX

SEQ ID NO: 2006 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDNLVRHXXXHXXXXXXXCXXCXXXXXRSDHLTTHXXXHXXXXXXXCXXCXXXXXSKKALTEHXXXHXXXXXXXCXXCXXXXXQRANLRAHXXXHXXXXXXXCXXCXXXXXRADNLTEHXXXHXXXXXXXCXXCXXXXXDPGHLVRHXXXHXXXXXXXCXXCXXXXXRNDALTEHXXXHXXXXXXXXXXX

SEQ ID NO: 2007 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDNLVRHXXXHXXXXXXXCXXCXXXXXRSDHLTTHXXXHXXXXXXXCXXCXXXXXRNDALTEHXXXHXXXXXXXCXXCXXXXXRSDNLVRHXXXHXXXXXXXCXXCXXXXXRSDHLTTHXXXHXXXXXXXCXXCXXXXXSKKALTEHXXXHXXXXXXXCXXCXXXXXQRANLRAHXXXHXXXXXXXXXXX

SEQ ID NO: 2008 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKALTEHXXXHXXXXXXXCXXCXXXXXQRANLRAHXXXHXXXXXXXCXXCXXXXXRADNLTEHXXXHXXXXXXXCXXCXXXXXDPGHLVRHXXXHXXXXXXXCXXCXXXXXRNDALTEHXXXHXXXXXXXCXXCXXXXXERSHLREHXXXHXXXXXXXCXXCXXXXXDCRDLARHXXXHXXXXXXXXXXX

SEQ ID NO: 2009 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTTHXXXHXXXXXXXCXXCXXXXXSKKALTEHXXXHXXXXXXXCXXCXXXXXQRANLRAHXXXHXXXXXXXCXXCXXXXXRADNLTEHXXXHXXXXXXXCXXCXXXXXDPGHLVRHXXXHXXXXXXXCXXCXXXXXRNDALTEHXXXHXXXXXXXCXXCXXXXXERSHLREHXXXHXXXXXXXXXXX

SEQ ID NO: 2010 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTTHXXXHXXXXXXXCXXCXXXXXRNDALTEHXXXHXXXXXXXCXXCXXXXXRSDNLVRHXXXHXXXXXXXCXXCXXXXXRSDHLTTHXXXHXXXXXXXCXXCXXXXXSKKALTEHXXXHXXXXXXXCXXCXXXXXQRANLRAHXXXHXXXXXXXCXXCXXXXXRADNLTEHXXXHXXXXXXXXXXX

SEQ ID NO: 2011 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRADNLTEHXXXHXXXXXXXCXXCXXXXXDPGHLVRHXXXHXXXXXXXCXXCXXXXXRNDALTEHXXXHXXXXXXXCXXCXXXXXERSHLREHXXXHXXXXXXXCXXCXXXXXDCRDLARHXXXHXXXXXXXCXXCXXXXXQRAHLERHXXXHXXXXXXXCXXCXXXXXTSGNLVRHXXXHXXXXXXXXXXX

SEQ ID NO: 2012 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQRANLRAHXXXHXXXXXXXCXXCXXXXXRADNLTEHXXXHXXXXXXXCXXCXXXXXDPGHLVRHXXXHXXXXXXXCXXCXXXXXRNDALTEHXXXHXXXXXXXCXXCXXXXXERSHLREHXXXHXXXXXXXCXXCXXXXXDCRDLARHXXXHXXXXXXXCXXCXXXXXQRAHLERHXXXHXXXXXXXXXXX

SEQ ID NO: 2013 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDNLVRHXXXHXXXXXXXCXXCXXXXXRTDTLRDHXXXHXXXXXXXCXXCXXXXXRSDNLVRHXXXHXXXXXXXCXXCXXXXXRSDHLTTHXXXHXXXXXXXCXXCXXXXXRNDALTEHXXXHXXXXXXXCXXCXXXXXRSDNLVRHXXXHXXXXXXXCXXCXXXXXRSDHLTTHXXXHXXXXXXXXXXX

SEQ ID NO: 2014 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTNHXXXHXXXXXXXCXXCXXXXXRSDNLVRHXXXHXXXXXXXCXXCXXXXXRTDTLRDHXXXHXXXXXXXCXXCXXXXXRSDNLVRHXXXHXXXXXXXCXXCXXXXXRSDHLTTHXXXHXXXXXXXCXXCXXXXXRNDALTEHXXXHXXXXXXXCXXCXXXXXRSDNLVRHXXXHXXXXXXXXXXX

SEQ ID NO: 2015 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGHLVRHXXXHXXXXXXXCXXCXXXXXRSDHLTNHXXXHXXXXXXXCXXCXXXXXRSDNLVRHXXXHXXXXXXXCXXCXXXXXRTDTLRDHXXXHXXXXXXXCXXCXXXXXRSDNLVRHXXXHXXXXXXXCXXCXXXXXRSDHLTTHXXXHXXXXXXXCXXCXXXXXRNDALTEHXXXHXXXXXXXXXXX

SEQ ID NO: 2016 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDELVRHXXXHXXXXXXXCXXCXXXXXRSDHLTNHXXXHXXXXXXXCXXCXXXXXDPGHLVRHXXXHXXXXXXXCXXCXXXXXRSDHLTNHXXXHXXXXXXXCXXCXXXXXRSDNLVRHXXXHXXXXXXXCXXCXXXXXRTDTLRDHXXXHXXXXXXXCXXCXXXXXRSDNLVRHXXXHXXXXXXXXXXX

SEQ ID NO: 2017 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTNHXXXHXXXXXXXCXXCXXXXXDPGHLVRHXXXHXXXXXXXCXXCXXXXXRSDHLTNHXXXHXXXXXXXCXXCXXXXXRSDNLVRHXXXHXXXXXXXCXXCXXXXXRTDTLRDHXXXHXXXXXXXCXXCXXXXXRSDNLVRHXXXHXXXXXXXCXXCXXXXXRSDHLTTHXXXHXXXXXXXXXXX

SEQ ID NO: 2018 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRTDTLRDHXXXHXXXXXXXCXXCXXXXXRSDNLVRHXXXHXXXXXXXCXXCXXXXXRSDHLTTHXXXHXXXXXXXCXXCXXXXXRNDALTEHXXXHXXXXXXXCXXCXXXXXRSDNLVRHXXXHXXXXXXXCXXCXXXXXRSDHLTTHXXXHXXXXXXXCXXCXXXXXSKKALTEHXXXHXXXXXXXXXXX

SEQ ID NO: 2019 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQRAHLERHXXXHXXXXXXXCXXCXXXXXRSDELVRHXXXHXXXXXXXCXXCXXXXXRSDHLTNHXXXHXXXXXXXCXXCXXXXXDPGHLVRHXXXHXXXXXXXCXXCXXXXXRSDHLTNHXXXHXXXXXXXCXXCXXXXXRSDNLVRHXXXHXXXXXXXCXXCXXXXXRTDTLRDHXXXHXXXXXXXXXXX

SEQ ID NO: 2020 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGHLVRHXXXHXXXXXXXCXXCXXXXXRNDALTEHXXXHXXXXXXXCXXCXXXXXERSHLREHXXXHXXXXXXXCXXCXXXXXDCRDLARHXXXHXXXXXXXCXXCXXXXXQRAHLERHXXXHXXXXXXXCXXCXXXXXTSGNLVRHXXXHXXXXXXXCXXCXXXXXQSGHLTEHXXXHXXXXXXXXXXX

SEQ ID NO: 2021 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXTHLDLIRHXXXHXXXXXXXCXXCXXXXXDSGNLRVHXXXHXXXXXXXCXXCXXXXXQLAHLRAHXXXHXXXXXXXCXXCXXXXXDCRDLARHXXXHXXXXXXXCXXCXXXXXRSDHLTTHXXXHXXXXXXXCXXCXXXXXDCRDLARHXXXHXXXXXXXXXXX

SEQ ID NO: 2022 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTHLDLIRHXXXHXXXXXXXCXXCXXXXXDSGNLRVHXXXHXXXXXXXCXXCXXXXXQLAHLRAHXXXHXXXXXXXCXXCXXXXXDCRDLARHXXXHXXXXXXXCXXCXXXXXRSDHLTTHXXXHXXXXXXXCXXCXXXXXDCRDLARHXXXHXXXXXXXCXXCXXXXXTSHSLTEHXXXHXXXXXXXXXXX

SEQ ID NO: 2023 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXERSHLREHXXXHXXXXXXXCXXCXXXXXRSDKLVRHXXXHXXXXXXXCXXCXXXXXTHLDLIRHXXXHXXXXXXXCXXCXXXXXDSGNLRVHXXXHXXXXXXXCXXCXXXXXQLAHLRAHXXXHXXXXXXXCXXCXXXXXDCRDLARHXXXHXXXXXXXCXXCXXXXXRSDHLTTHXXXHXXXXXXXXXXX

SEQ ID NO: 2024 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDSGNLRVHXXXHXXXXXXXCXXCXXXXXQLAHLRAHXXXHXXXXXXXCXXCXXXXXDCRDLARHXXXHXXXXXXXCXXCXXXXXRSDHLTTHXXXHXXXXXXXCXXCXXXXXDCRDLARHXXXHXXXXXXXCXXCXXXXXTSHSLTEHXXXHXXXXXXXCXXCXXXXXRSDNLVRHXXXHXXXXXXXXXXX

SEQ ID NO: 2025 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQLAHLRAHXXXHXXXXXXXCXXCXXXXXDCRDLARHXXXHXXXXXXXCXXCXXXXXRSDHLTTHXXXHXXXXXXXCXXCXXXXXDCRDLARHXXXHXXXXXXXCXXCXXXXXTSHSLTEHXXXHXXXXXXXCXXCXXXXXRSDNLVRHXXXHXXXXXXXCXXCXXXXXRRDELNVHXXXHXXXXXXXXXXX

SEQ ID NO: 2026 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDCRDLARHXXXHXXXXXXXCXXCXXXXXRSDHLTTHXXXHXXXXXXXCXXCXXXXXDCRDLARHXXXHXXXXXXXCXXCXXXXXTSHSLTEHXXXHXXXXXXXCXXCXXXXXRSDNLVRHXXXHXXXXXXXCXXCXXXXXRRDELNVHXXXHXXXXXXXCXXCXXXXXRSDNLVRHXXXHXXXXXXXXXXX

SEQ ID NO: 2027 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXQSGDLRRHXXXHXXXXXXXCXXCXXXXXRSDKLVRHXXXHXXXXXXXCXXCXXXXXQLAHLRAHXXXHXXXXXXXCXXCXXXXXRSDKLTEHXXXHXXXXXXXCXXCXXXXXQLAHLRAHXXXHXXXXXXXCXXCXXXXXRSDKLVRHXXXHXXXXXXXXXXX

SEQ ID NO: 2028 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTTHXXXHXXXXXXXCXXCXXXXXRSDKLVRHXXXHXXXXXXXCXXCXXXXXQSGDLRRHXXXHXXXXXXXCXXCXXXXXRSDKLVRHXXXHXXXXXXXCXXCXXXXXQLAHLRAHXXXHXXXXXXXCXXCXXXXXRSDKLTEHXXXHXXXXXXXCXXCXXXXXQLAHLRAHXXXHXXXXXXXXXXX

SEQ ID NO: 2029 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGNLVRHXXXHXXXXXXXCXXCXXXXXRSDHLTTHXXXHXXXXXXXCXXCXXXXXRSDKLVRHXXXHXXXXXXXCXXCXXXXXQSGDLRRHXXXHXXXXXXXCXXCXXXXXRSDKLVRHXXXHXXXXXXXCXXCXXXXXQLAHLRAHXXXHXXXXXXXCXXCXXXXXRSDKLTEHXXXHXXXXXXXXXXX

SEQ ID NO: 2030 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKALTEHXXXHXXXXXXXCXXCXXXXXTSGNLVRHXXXHXXXXXXXCXXCXXXXXRSDHLTTHXXXHXXXXXXXCXXCXXXXXRSDKLVRHXXXHXXXXXXXCXXCXXXXXQSGDLRRHXXXHXXXXXXXCXXCXXXXXRSDKLVRHXXXHXXXXXXXCXXCXXXXXQLAHLRAHXXXHXXXXXXXXXXX

SEQ ID NO: 2031 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLTEHXXXHXXXXXXXCXXCXXXXXRSDNLVRHXXXHXXXXXXXCXXCXXXXXRADNLTEHXXXHXXXXXXXCXXCXXXXXRSDNLVRHXXXHXXXXXXXCXXCXXXXXRSDHLTNHXXXHXXXXXXXCXXCXXXXXSKKALTEHXXXHXXXXXXXCXXCXXXXXTSGNLVRHXXXHXXXXXXXXXXX

SEQ ID NO: 2032 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTNHXXXHXXXXXXXCXXCXXXXXSKKALTEHXXXHXXXXXXXCXXCXXXXXTSGNLVRHXXXHXXXXXXXCXXCXXXXXRSDHLTTHXXXHXXXXXXXCXXCXXXXXRSDKLVRHXXXHXXXXXXXCXXCXXXXXQSGDLRRHXXXHXXXXXXXCXXCXXXXXRSDKLVRHXXXHXXXXXXXXXXX

SEQ ID NO: 2033 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRADNLTEHXXXHXXXXXXXCXXCXXXXXRSDNLVRHXXXHXXXXXXXCXXCXXXXXRSDHLTNHXXXHXXXXXXXCXXCXXXXXSKKALTEHXXXHXXXXXXXCXXCXXXXXTSGNLVRHXXXHXXXXXXXCXXCXXXXXRSDHLTTHXXXHXXXXXXXCXXCXXXXXRSDKLVRHXXXHXXXXXXXXXXX

SEQ ID NO: 2034 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDNLVRHXXXHXXXXXXXCXXCXXXXXRADNLTEHXXXHXXXXXXXCXXCXXXXXRSDNLVRHXXXHXXXXXXXCXXCXXXXXRSDHLTNHXXXHXXXXXXXCXXCXXXXXSKKALTEHXXXHXXXXXXXCXXCXXXXXTSGNLVRHXXXHXXXXXXXCXXCXXXXXRSDHLTTHXXXHXXXXXXXXXXX

SEQ ID NO: 2035 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDNLVRHXXXHXXXXXXXCXXCXXXXXRSDHLTNHXXXHXXXXXXXCXXCXXXXXSKKALTEHXXXHXXXXXXXCXXCXXXXXTSGNLVRHXXXHXXXXXXXCXXCXXXXXRSDHLTTHXXXHXXXXXXXCXXCXXXXXRSDKLVRHXXXHXXXXXXXCXXCXXXXXQSGDLRRHXXXHXXXXXXXXXXX

SEQ ID NO: 2036 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXHKNALQNHXXXHXXXXXXXCXXCXXXXXQRAHLERHXXXHXXXXXXXCXXCXXXXXRSDKLTEHXXXHXXXXXXXCXXCXXXXXRSDNLVRHXXXHXXXXXXXCXXCXXXXXRADNLTEHXXXHXXXXXXXCXXCXXXXXRSDNLVRHXXXHXXXXXXXCXXCXXXXXRSDHLTNHXXXHXXXXXXXXXXX

SEQ ID NO: 2037 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQRAHLERHXXXHXXXXXXXCXXCXXXXXRSDKLTEHXXXHXXXXXXXCXXCXXXXXRSDNLVRHXXXHXXXXXXXCXXCXXXXXRADNLTEHXXXHXXXXXXXCXXCXXXXXRSDNLVRHXXXHXXXXXXXCXXCXXXXXRSDHLTNHXXXHXXXXXXXCXXCXXXXXSKKALTEHXXXHXXXXXXXXXXX

SEQ ID NO: 2038 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQRAHLERHXXXHXXXXXXXCXXCXXXXXHKNALQNHXXXHXXXXXXXCXXCXXXXXQRAHLERHXXXHXXXXXXXCXXCXXXXXRSDKLTEHXXXHXXXXXXXCXXCXXXXXRSDNLVRHXXXHXXXXXXXCXXCXXXXXRADNLTEHXXXHXXXXXXXCXXCXXXXXRSDNLVRHXXXHXXXXXXXXXXX

SEQ ID NO: 2039 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGHLVRHXXXHXXXXXXXCXXCXXXXXQRAHLERHXXXHXXXXXXXCXXCXXXXXHKNALQNHXXXHXXXXXXXCXXCXXXXXQRAHLERHXXXHXXXXXXXCXXCXXXXXRSDKLTEHXXXHXXXXXXXCXXCXXXXXRSDNLVRHXXXHXXXXXXXCXXCXXXXXRADNLTEHXXXHXXXXXXXXXXX

SEQ ID NO: 2040 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSSNLVRHXXXHXXXXXXXCXXCXXXXXTSGHLVRHXXXHXXXXXXXCXXCXXXXXQRAHLERHXXXHXXXXXXXCXXCXXXXXHKNALQNHXXXHXXXXXXXCXXCXXXXXQRAHLERHXXXHXXXXXXXCXXCXXXXXRSDKLTEHXXXHXXXXXXXCXXCXXXXXRSDNLVRHXXXHXXXXXXXXXXX

SEQ ID NO: 2041 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSSNLVRHXXXHXXXXXXXCXXCXXXXXRSDKLVRHXXXHXXXXXXXCXXCXXXXXERSHLREHXXXHXXXXXXXCXXCXXXXXRSDHLTNHXXXHXXXXXXXCXXCXXXXXERSHLREHXXXHXXXXXXXCXXCXXXXXRSDKLVRHXXXHXXXXXXXCXXCXXXXXSPADLTRHXXXHXXXXXXXXXXX

SEQ ID NO: 2042 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTNHXXXHXXXXXXXCXXCXXXXXRSDHLTTHXXXHXXXXXXXCXXCXXXXXTTGNLTVHXXXHXXXXXXXCXXCXXXXXRSDKLVRHXXXHXXXXXXXCXXCXXXXXRSDDLVRHXXXHXXXXXXXCXXCXXXXXQRAHLERHXXXHXXXXXXXCXXCXXXXXQSGDLRRHXXXHXXXXXXXXXXX

SEQ ID NO: 2043 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQAGHLASHXXXHXXXXXXXCXXCXXXXXRSDHLTNHXXXHXXXXXXXCXXCXXXXXRSDHLTTHXXXHXXXXXXXCXXCXXXXXTTGNLTVHXXXHXXXXXXXCXXCXXXXXRSDKLVRHXXXHXXXXXXXCXXCXXXXXRSDDLVRHXXXHXXXXXXXCXXCXXXXXQRAHLERHXXXHXXXXXXXXXXX

SEQ ID NO: 2044 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTTGNLTVHXXXHXXXXXXXCXXCXXXXXRSDKLVRHXXXHXXXXXXXCXXCXXXXXRSDDLVRHXXXHXXXXXXXCXXCXXXXXQRAHLERHXXXHXXXXXXXCXXCXXXXXQSGDLRRHXXXHXXXXXXXCXXCXXXXXQRAHLERHXXXHXXXXXXXCXXCXXXXXRADNLTEHXXXHXXXXXXXXXXX

SEQ ID NO: 2045 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTTHXXXHXXXXXXXCXXCXXXXXTTGNLTVHXXXHXXXXXXXCXXCXXXXXRSDKLVRHXXXHXXXXXXXCXXCXXXXXRSDDLVRHXXXHXXXXXXXCXXCXXXXXQRAHLERHXXXHXXXXXXXCXXCXXXXXQSGDLRRHXXXHXXXXXXXCXXCXXXXXQRAHLERHXXXHXXXXXXXXXXX

SEQ ID NO: 2046 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGALVRHXXXHXXXXXXXCXXCXXXXXTSHSLTEHXXXHXXXXXXXCXXCXXXXXTTGALTEHXXXHXXXXXXXCXXCXXXXXQRANLRAHXXXHXXXXXXXCXXCXXXXXSKKHLAEHXXXHXXXXXXXCXXCXXXXXTKNSLTEHXXXHXXXXXXXCXXCXXXXXDPGHLVRHXXXHXXXXXXXXXXX

SEQ ID NO: 2047 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGNLTEHXXXHXXXXXXXCXXCXXXXXDPGALVRHXXXHXXXXXXXCXXCXXXXXTSHSLTEHXXXHXXXXXXXCXXCXXXXXTTGALTEHXXXHXXXXXXXCXXCXXXXXQRANLRAHXXXHXXXXXXXCXXCXXXXXSKKHLAEHXXXHXXXXXXXCXXCXXXXXTKNSLTEHXXXHXXXXXXXXXXX

SEQ ID NO: 2048 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTTHXXXHXXXXXXXCXXCXXXXXDSGNLRVHXXXHXXXXXXXCXXCXXXXXRSDKLVRHXXXHXXXXXXXCXXCXXXXXRSDKLTEHXXXHXXXXXXXCXXCXXXXXRNDALTEHXXXHXXXXXXXCXXCXXXXXQRANLRAHXXXHXXXXXXXCXXCXXXXXRSDKLVRHXXXHXXXXXXXXXXX

SEQ ID NO: 2049 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDSGNLRVHXXXHXXXXXXXCXXCXXXXXRSDKLVRHXXXHXXXXXXXCXXCXXXXXRSDKLTEHXXXHXXXXXXXCXXCXXXXXRNDALTEHXXXHXXXXXXXCXXCXXXXXQRANLRAHXXXHXXXXXXXCXXCXXXXXRSDKLVRHXXXHXXXXXXXCXXCXXXXXDKKDLTRHXXXHXXXXXXXXXXX

SEQ ID NO: 2050 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRKDNLKNHXXXHXXXXXXXCXXCXXXXXRSDHLTTHXXXHXXXXXXXCXXCXXXXXDSGNLRVHXXXHXXXXXXXCXXCXXXXXRSDKLVRHXXXHXXXXXXXCXXCXXXXXRSDKLTEHXXXHXXXXXXXCXXCXXXXXRNDALTEHXXXHXXXXXXXCXXCXXXXXQRANLRAHXXXHXXXXXXXXXXX

SEQ ID NO: 2051 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXRSDKLTEHXXXHXXXXXXXCXXCXXXXXRNDALTEHXXXHXXXXXXXCXXCXXXXXQRANLRAHXXXHXXXXXXXCXXCXXXXXRSDKLVRHXXXHXXXXXXXCXXCXXXXXDKKDLTRHXXXHXXXXXXXCXXCXXXXXQRAHLERHXXXHXXXXXXXXXXX

SEQ ID NO: 2052 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLTEHXXXHXXXXXXXCXXCXXXXXRNDALTEHXXXHXXXXXXXCXXCXXXXXQRANLRAHXXXHXXXXXXXCXXCXXXXXRSDKLVRHXXXHXXXXXXXCXXCXXXXXDKKDLTRHXXXHXXXXXXXCXXCXXXXXQRAHLERHXXXHXXXXXXXCXXCXXXXXRSDHLTNHXXXHXXXXXXXXXXX

SEQ ID NO: 2053 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQRAHLERHXXXHXXXXXXXCXXCXXXXXRKDNLKNHXXXHXXXXXXXCXXCXXXXXRSDHLTTHXXXHXXXXXXXCXXCXXXXXDSGNLRVHXXXHXXXXXXXCXXCXXXXXRSDKLVRHXXXHXXXXXXXCXXCXXXXXRSDKLTEHXXXHXXXXXXXCXXCXXXXXRNDALTEHXXXHXXXXXXXXXXX

SEQ ID NO: 2054 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGELVRHXXXHXXXXXXXCXXCXXXXXQRAHLERHXXXHXXXXXXXCXXCXXXXXRKDNLKNHXXXHXXXXXXXCXXCXXXXXRSDHLTTHXXXHXXXXXXXCXXCXXXXXDSGNLRVHXXXHXXXXXXXCXXCXXXXXRSDKLVRHXXXHXXXXXXXCXXCXXXXXRSDKLTEHXXXHXXXXXXXXXXX

SEQ ID NO: 2055 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRNDALTEHXXXHXXXXXXXCXXCXXXXXQRANLRAHXXXHXXXXXXXCXXCXXXXXRSDKLVRHXXXHXXXXXXXCXXCXXXXXDKKDLTRHXXXHXXXXXXXCXXCXXXXXQRAHLERHXXXHXXXXXXXCXXCXXXXXRSDHLTNHXXXHXXXXXXXCXXCXXXXXSKKHLAEHXXXHXXXXXXXXXXX

SEQ ID NO: 2056 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQRANLRAHXXXHXXXXXXXCXXCXXXXXRSDKLVRHXXXHXXXXXXXCXXCXXXXXDKKDLTRHXXXHXXXXXXXCXXCXXXXXQRAHLERHXXXHXXXXXXXCXXCXXXXXRSDHLTNHXXXHXXXXXXXCXXCXXXXXSKKHLAEHXXXHXXXXXXXCXXCXXXXXTSGELVRHXXXHXXXXXXXXXXX

SEQ ID NO: 2057 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKHLAEHXXXHXXXXXXXCXXCXXXXXTSGELVRHXXXHXXXXXXXCXXCXXXXXQRAHLERHXXXHXXXXXXXCXXCXXXXXRKDNLKNHXXXHXXXXXXXCXXCXXXXXRSDHLTTHXXXHXXXXXXXCXXCXXXXXDSGNLRVHXXXHXXXXXXXCXXCXXXXXRSDKLVRHXXXHXXXXXXXXXXX

SEQ ID NO: 2058 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQLAHLRAHXXXHXXXXXXXCXXCXXXXXSKKHLAEHXXXHXXXXXXXCXXCXXXXXTSGELVRHXXXHXXXXXXXCXXCXXXXXQRAHLERHXXXHXXXXXXXCXXCXXXXXRKDNLKNHXXXHXXXXXXXCXXCXXXXXRSDHLTTHXXXHXXXXXXXCXXCXXXXXDSGNLRVHXXXHXXXXXXXXXXX

SEQ ID NO: 2059 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSPADLTRHXXXHXXXXXXXCXXCXXXXXQLAHLRAHXXXHXXXXXXXCXXCXXXXXSKKHLAEHXXXHXXXXXXXCXXCXXXXXTSGELVRHXXXHXXXXXXXCXXCXXXXXQRAHLERHXXXHXXXXXXXCXXCXXXXXRKDNLKNHXXXHXXXXXXXCXXCXXXXXRSDHLTTHXXXHXXXXXXXXXXX

SEQ ID NO: 2060 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTNHXXXHXXXXXXXCXXCXXXXXSPADLTRHXXXHXXXXXXXCXXCXXXXXQLAHLRAHXXXHXXXXXXXCXXCXXXXXSKKHLAEHXXXHXXXXXXXCXXCXXXXXTSGELVRHXXXHXXXXXXXCXXCXXXXXQRAHLERHXXXHXXXXXXXCXXCXXXXXRKDNLKNHXXXHXXXXXXXXXXX

SEQ ID NO: 2061 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDDLVRHXXXHXXXXXXXCXXCXXXXXTHLDLIRHXXXHXXXXXXXCXXCXXXXXQSSNLVRHXXXHXXXXXXXCXXCXXXXXRSDKLTEHXXXHXXXXXXXCXXCXXXXXDSGNLRVHXXXHXXXXXXXCXXCXXXXXRSDKLVRHXXXHXXXXXXXCXXCXXXXXRADNLTEHXXXHXXXXXXXXXXX

SEQ ID NO: 2062 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXRSDDLVRHXXXHXXXXXXXCXXCXXXXXTHLDLIRHXXXHXXXXXXXCXXCXXXXXQSSNLVRHXXXHXXXXXXXCXXCXXXXXRSDKLTEHXXXHXXXXXXXCXXCXXXXXDSGNLRVHXXXHXXXXXXXCXXCXXXXXRSDKLVRHXXXHXXXXXXXXXXX

SEQ ID NO: 2063 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSSNLVRHXXXHXXXXXXXCXXCXXXXXRSDKLVRHXXXHXXXXXXXCXXCXXXXXRSDDLVRHXXXHXXXXXXXCXXCXXXXXTHLDLIRHXXXHXXXXXXXCXXCXXXXXQSSNLVRHXXXHXXXXXXXCXXCXXXXXRSDKLTEHXXXHXXXXXXXCXXCXXXXXDSGNLRVHXXXHXXXXXXXXXXX

SEQ ID NO: 2064 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXERSHLREHXXXHXXXXXXXCXXCXXXXXRSDKLVRHXXXHXXXXXXXCXXCXXXXXQSSNLVRHXXXHXXXXXXXCXXCXXXXXRNDALTEHXXXHXXXXXXXCXXCXXXXXQSSNLVRHXXXHXXXXXXXCXXCXXXXXRSDKLVRHXXXHXXXXXXXCXXCXXXXXRSDDLVRHXXXHXXXXXXXXXXX

SEQ ID NO: 2065 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXQSSNLVRHXXXHXXXXXXXCXXCXXXXXRNDALTEHXXXHXXXXXXXCXXCXXXXXQSSNLVRHXXXHXXXXXXXCXXCXXXXXRSDKLVRHXXXHXXXXXXXCXXCXXXXXRSDDLVRHXXXHXXXXXXXCXXCXXXXXTHLDLIRHXXXHXXXXXXXXXXX

SEQ ID NO: 2066 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRNDALTEHXXXHXXXXXXXCXXCXXXXXQSSNLVRHXXXHXXXXXXXCXXCXXXXXRSDKLVRHXXXHXXXXXXXCXXCXXXXXRSDDLVRHXXXHXXXXXXXCXXCXXXXXTHLDLIRHXXXHXXXXXXXCXXCXXXXXQSSNLVRHXXXHXXXXXXXCXXCXXXXXRSDKLTEHXXXHXXXXXXXXXXX

SEQ ID NO: 2067 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSSNLVRHXXXHXXXXXXXCXXCXXXXXRNDALTEHXXXHXXXXXXXCXXCXXXXXQSSNLVRHXXXHXXXXXXXCXXCXXXXXRSDKLVRHXXXHXXXXXXXCXXCXXXXXRSDDLVRHXXXHXXXXXXXCXXCXXXXXTHLDLIRHXXXHXXXXXXXCXXCXXXXXQSSNLVRHXXXHXXXXXXXXXXX

SEQ ID NO: 2068 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXREDNLHTHXXXHXXXXXXXCXXCXXXXXHKNALQNHXXXHXXXXXXXCXXCXXXXXRSDKLVRHXXXHXXXXXXXCXXCXXXXXTKNSLTEHXXXHXXXXXXXCXXCXXXXXRSDKLVRHXXXHXXXXXXXCXXCXXXXXRNDALTEHXXXHXXXXXXXCXXCXXXXXTSGNLTEHXXXHXXXXXXXXXXX

SEQ ID NO: 2069 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXTKNSLTEHXXXHXXXXXXXCXXCXXXXXRSDKLVRHXXXHXXXXXXXCXXCXXXXXRNDALTEHXXXHXXXXXXXCXXCXXXXXTSGNLTEHXXXHXXXXXXXCXXCXXXXXRSDHLTTHXXXHXXXXXXXCXXCXXXXXTSGNLVRHXXXHXXXXXXXXXXX

SEQ ID NO: 2070 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXHKNALQNHXXXHXXXXXXXCXXCXXXXXRSDKLVRHXXXHXXXXXXXCXXCXXXXXTKNSLTEHXXXHXXXXXXXCXXCXXXXXRSDKLVRHXXXHXXXXXXXCXXCXXXXXRNDALTEHXXXHXXXXXXXCXXCXXXXXTSGNLTEHXXXHXXXXXXXCXXCXXXXXRSDHLTTHXXXHXXXXXXXXXXX

SEQ ID NO: 2071 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGNLVRHXXXHXXXXXXXCXXCXXXXXQSSNLVRHXXXHXXXXXXXCXXCXXXXXTSHSLTEHXXXHXXXXXXXCXXCXXXXXTSGNLVRHXXXHXXXXXXXCXXCXXXXXRKDNLKNHXXXHXXXXXXXCXXCXXXXXDSGNLRVHXXXHXXXXXXXCXXCXXXXXRADNLTEHXXXHXXXXXXXXXXX

SEQ ID NO: 2072 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTKNSLTEHXXXHXXXXXXXCXXCXXXXXRSDKLVRHXXXHXXXXXXXCXXCXXXXXRNDALTEHXXXHXXXXXXXCXXCXXXXXTSGNLTEHXXXHXXXXXXXCXXCXXXXXRSDHLTTHXXXHXXXXXXXCXXCXXXXXTSGNLVRHXXXHXXXXXXXCXXCXXXXXQSSNLVRHXXXHXXXXXXXXXXX

SEQ ID NO: 2073 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTTHXXXHXXXXXXXCXXCXXXXXTSGNLVRHXXXHXXXXXXXCXXCXXXXXQSSNLVRHXXXHXXXXXXXCXXCXXXXXTSHSLTEHXXXHXXXXXXXCXXCXXXXXTSGNLVRHXXXHXXXXXXXCXXCXXXXXRKDNLKNHXXXHXXXXXXXCXXCXXXXXDSGNLRVHXXXHXXXXXXXXXXX

SEQ ID NO: 2074 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXRNDALTEHXXXHXXXXXXXCXXCXXXXXTSGNLTEHXXXHXXXXXXXCXXCXXXXXRSDHLTTHXXXHXXXXXXXCXXCXXXXXTSGNLVRHXXXHXXXXXXXCXXCXXXXXQSSNLVRHXXXHXXXXXXXCXXCXXXXXTSHSLTEHXXXHXXXXXXXXXXX

SEQ ID NO: 2075 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRNDALTEHXXXHXXXXXXXCXXCXXXXXTSGNLTEHXXXHXXXXXXXCXXCXXXXXRSDHLTTHXXXHXXXXXXXCXXCXXXXXTSGNLVRHXXXHXXXXXXXCXXCXXXXXQSSNLVRHXXXHXXXXXXXCXXCXXXXXTSHSLTEHXXXHXXXXXXXCXXCXXXXXTSGNLVRHXXXHXXXXXXXXXXX

SEQ ID NO: 2076 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGNLTEHXXXHXXXXXXXCXXCXXXXXRSDHLTTHXXXHXXXXXXXCXXCXXXXXTSGNLVRHXXXHXXXXXXXCXXCXXXXXQSSNLVRHXXXHXXXXXXXCXXCXXXXXTSHSLTEHXXXHXXXXXXXCXXCXXXXXTSGNLVRHXXXHXXXXXXXCXXCXXXXXRKDNLKNHXXXHXXXXXXXXXXX

SEQ ID NO: 2077 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGSLVRHXXXHXXXXXXXCXXCXXXXXREDNLHTHXXXHXXXXXXXCXXCXXXXXHKNALQNHXXXHXXXXXXXCXXCXXXXXRSDKLVRHXXXHXXXXXXXCXXCXXXXXTKNSLTEHXXXHXXXXXXXCXXCXXXXXRSDKLVRHXXXHXXXXXXXCXXCXXXXXRNDALTEHXXXHXXXXXXXXXXX

SEQ ID NO: 2078 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGHLVRHXXXHXXXXXXXCXXCXXXXXRSDHLTTHXXXHXXXXXXXCXXCXXXXXTSHSLTEHXXXHXXXXXXXCXXCXXXXXRSDKLVRHXXXHXXXXXXXCXXCXXXXXSRRTCRAHXXXHXXXXXXXCXXCXXXXXTTGNLTVHXXXHXXXXXXXCXXCXXXXXQNSTLTEHXXXHXXXXXXXXXXX

SEQ ID NO: 2079 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXERSHLREHXXXHXXXXXXXCXXCXXXXXDPGHLVRHXXXHXXXXXXXCXXCXXXXXRSDHLTTHXXXHXXXXXXXCXXCXXXXXTSHSLTEHXXXHXXXXXXXCXXCXXXXXRSDKLVRHXXXHXXXXXXXCXXCXXXXXSRRTCRAHXXXHXXXXXXXCXXCXXXXXTTGNLTVHXXXHXXXXXXXXXXX

SEQ ID NO: 2080 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTTGALTEHXXXHXXXXXXXCXXCXXXXXERSHLREHXXXHXXXXXXXCXXCXXXXXDPGHLVRHXXXHXXXXXXXCXXCXXXXXRSDHLTTHXXXHXXXXXXXCXXCXXXXXTSHSLTEHXXXHXXXXXXXCXXCXXXXXRSDKLVRHXXXHXXXXXXXCXXCXXXXXSRRTCRAHXXXHXXXXXXXXXXX

SEQ ID NO: 2081 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXREDNLHTHXXXHXXXXXXXCXXCXXXXXRSDKLVRHXXXHXXXXXXXCXXCXXXXXQAGHLASHXXXHXXXXXXXCXXCXXXXXTSGNLTEHXXXHXXXXXXXCXXCXXXXXRKDNLKNHXXXHXXXXXXXCXXCXXXXXQSGNLTEHXXXHXXXXXXXCXXCXXXXXRNDALTEHXXXHXXXXXXXXXXX

SEQ ID NO: 2082 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRKDNLKNHXXXHXXXXXXXCXXCXXXXXREDNLHTHXXXHXXXXXXXCXXCXXXXXRSDKLVRHXXXHXXXXXXXCXXCXXXXXQAGHLASHXXXHXXXXXXXCXXCXXXXXTSGNLTEHXXXHXXXXXXXCXXCXXXXXRKDNLKNHXXXHXXXXXXXCXXCXXXXXQSGNLTEHXXXHXXXXXXXXXXX

SEQ ID NO: 2083 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXHRTTLTNHXXXHXXXXXXXCXXCXXXXXQLAHLRAHXXXHXXXXXXXCXXCXXXXXTSGHLVRHXXXHXXXXXXXCXXCXXXXXRSDNLVRHXXXHXXXXXXXCXXCXXXXXHKNALQNHXXXHXXXXXXXCXXCXXXXXERSHLREHXXXHXXXXXXXCXXCXXXXXQRANLRAHXXXHXXXXXXXXXXX

SEQ ID NO: 2084 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQAGHLASHXXXHXXXXXXXCXXCXXXXXQSGNLTEHXXXHXXXXXXXCXXCXXXXXHRTTLTNHXXXHXXXXXXXCXXCXXXXXQLAHLRAHXXXHXXXXXXXCXXCXXXXXTSGHLVRHXXXHXXXXXXXCXXCXXXXXRSDNLVRHXXXHXXXXXXXCXXCXXXXXHKNALQNHXXXHXXXXXXXXXXX

SEQ ID NO: 2085 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSGNLTEHXXXHXXXXXXXCXXCXXXXXHRTTLTNHXXXHXXXXXXXCXXCXXXXXQLAHLRAHXXXHXXXXXXXCXXCXXXXXTSGHLVRHXXXHXXXXXXXCXXCXXXXXRSDNLVRHXXXHXXXXXXXCXXCXXXXXHKNALQNHXXXHXXXXXXXCXXCXXXXXERSHLREHXXXHXXXXXXXXXXX

SEQ ID NO: 2086 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSSNLVRHXXXHXXXXXXXCXXCXXXXXHKNALQNHXXXHXXXXXXXCXXCXXXXXTSGSLVRHXXXHXXXXXXXCXXCXXXXXQSSNLVRHXXXHXXXXXXXCXXCXXXXXRSDHLTTHXXXHXXXXXXXCXXCXXXXXHKNALQNHXXXHXXXXXXXCXXCXXXXXRRDELNVHXXXHXXXXXXXXXXX

SEQ ID NO: 2087 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXREDNLHTHXXXHXXXXXXXCXXCXXXXXQAGHLASHXXXHXXXXXXXCXXCXXXXXDCRDLARHXXXHXXXXXXXCXXCXXXXXHRTTLTNHXXXHXXXXXXXCXXCXXXXXDPGALVRHXXXHXXXXXXXCXXCXXXXXTSGELVRHXXXHXXXXXXXCXXCXXXXXREDNLHTHXXXHXXXXXXXXXXX

SEQ ID NO: 2088 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQAGHLASHXXXHXXXXXXXCXXCXXXXXDCRDLARHXXXHXXXXXXXCXXCXXXXXHRTTLTNHXXXHXXXXXXXCXXCXXXXXDPGALVRHXXXHXXXXXXXCXXCXXXXXTSGELVRHXXXHXXXXXXXCXXCXXXXXREDNLHTHXXXHXXXXXXXCXXCXXXXXRSDHLTNHXXXHXXXXXXXXXXX

SEQ ID NO: 2089 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDCRDLARHXXXHXXXXXXXCXXCXXXXXHRTTLTNHXXXHXXXXXXXCXXCXXXXXDPGALVRHXXXHXXXXXXXCXXCXXXXXTSGELVRHXXXHXXXXXXXCXXCXXXXXREDNLHTHXXXHXXXXXXXCXXCXXXXXRSDHLTNHXXXHXXXXXXXCXXCXXXXXRSDKLTEHXXXHXXXXXXXXXXX

SEQ ID NO: 2090 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDELVRHXXXHXXXXXXXCXXCXXXXXRSDKLVRHXXXHXXXXXXXCXXCXXXXXTTGALTEHXXXHXXXXXXXCXXCXXXXXQAGHLASHXXXHXXXXXXXCXXCXXXXXDCRDLARHXXXHXXXXXXXCXXCXXXXXTTGNLTVHXXXHXXXXXXXCXXCXXXXXREDNLHTHXXXHXXXXXXXXXXX

SEQ ID NO: 2091 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSPADLTRHXXXHXXXXXXXCXXCXXXXXRSDELVRHXXXHXXXXXXXCXXCXXXXXRSDKLVRHXXXHXXXXXXXCXXCXXXXXTTGALTEHXXXHXXXXXXXCXXCXXXXXQAGHLASHXXXHXXXXXXXCXXCXXXXXDCRDLARHXXXHXXXXXXXCXXCXXXXXTTGNLTVHXXXHXXXXXXXXXXX

SEQ ID NO: 2092 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXTTGALTEHXXXHXXXXXXXCXXCXXXXXQAGHLASHXXXHXXXXXXXCXXCXXXXXDCRDLARHXXXHXXXXXXXCXXCXXXXXTTGNLTVHXXXHXXXXXXXCXXCXXXXXREDNLHTHXXXHXXXXXXXCXXCXXXXXHRTTLTNHXXXHXXXXXXXXXXX

SEQ ID NO: 2093 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRRDELNVHXXXHXXXXXXXCXXCXXXXXSPADLTRHXXXHXXXXXXXCXXCXXXXXRSDELVRHXXXHXXXXXXXCXXCXXXXXRSDKLVRHXXXHXXXXXXXCXXCXXXXXTTGALTEHXXXHXXXXXXXCXXCXXXXXQAGHLASHXXXHXXXXXXXCXXCXXXXXDCRDLARHXXXHXXXXXXXXXXX

SEQ ID NO: 2094 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTNHXXXHXXXXXXXCXXCXXXXXRSDHLTTHXXXHXXXXXXXCXXCXXXXXTSGELVRHXXXHXXXXXXXCXXCXXXXXRRDELNVHXXXHXXXXXXXCXXCXXXXXSPADLTRHXXXHXXXXXXXCXXCXXXXXRSDELVRHXXXHXXXXXXXCXXCXXXXXRSDKLVRHXXXHXXXXXXXXXXX

SEQ ID NO: 2095 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGELVRHXXXHXXXXXXXCXXCXXXXXRRDELNVHXXXHXXXXXXXCXXCXXXXXSPADLTRHXXXHXXXXXXXCXXCXXXXXRSDELVRHXXXHXXXXXXXCXXCXXXXXRSDKLVRHXXXHXXXXXXXCXXCXXXXXTTGALTEHXXXHXXXXXXXCXXCXXXXXQAGHLASHXXXHXXXXXXXXXXX

SEQ ID NO: 2096 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGALVRHXXXHXXXXXXXCXXCXXXXXQAGHLASHXXXHXXXXXXXCXXCXXXXXRSDKLVRHXXXHXXXXXXXCXXCXXXXXTSGHLVRHXXXHXXXXXXXCXXCXXXXXRSDHLTNHXXXHXXXXXXXCXXCXXXXXRSDHLTTHXXXHXXXXXXXCXXCXXXXXTSGELVRHXXXHXXXXXXXXXXX

SEQ ID NO: 2097 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRKDNLKNHXXXHXXXXXXXCXXCXXXXXDPGALVRHXXXHXXXXXXXCXXCXXXXXQAGHLASHXXXHXXXXXXXCXXCXXXXXRSDKLVRHXXXHXXXXXXXCXXCXXXXXTSGHLVRHXXXHXXXXXXXCXXCXXXXXRSDHLTNHXXXHXXXXXXXCXXCXXXXXRSDHLTTHXXXHXXXXXXXXXXX

SEQ ID NO: 2098 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGHLVRHXXXHXXXXXXXCXXCXXXXXRSDHLTNHXXXHXXXXXXXCXXCXXXXXRSDHLTTHXXXHXXXXXXXCXXCXXXXXTSGELVRHXXXHXXXXXXXCXXCXXXXXRRDELNVHXXXHXXXXXXXCXXCXXXXXSPADLTRHXXXHXXXXXXXCXXCXXXXXRSDELVRHXXXHXXXXXXXXXXX

SEQ ID NO: 2099 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQAGHLASHXXXHXXXXXXXCXXCXXXXXRSDKLVRHXXXHXXXXXXXCXXCXXXXXTSGHLVRHXXXHXXXXXXXCXXCXXXXXRSDHLTNHXXXHXXXXXXXCXXCXXXXXRSDHLTTHXXXHXXXXXXXCXXCXXXXXTSGELVRHXXXHXXXXXXXCXXCXXXXXRRDELNVHXXXHXXXXXXXXXXX

SEQ ID NO: 2100 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXTSGHLVRHXXXHXXXXXXXCXXCXXXXXRSDHLTNHXXXHXXXXXXXCXXCXXXXXRSDHLTTHXXXHXXXXXXXCXXCXXXXXTSGELVRHXXXHXXXXXXXCXXCXXXXXRRDELNVHXXXHXXXXXXXCXXCXXXXXSPADLTRHXXXHXXXXXXXXXXX

SEQ ID NO: 2101 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRRDELNVHXXXHXXXXXXXCXXCXXXXXQSGNLTEHXXXHXXXXXXXCXXCXXXXXTSGHLVRHXXXHXXXXXXXCXXCXXXXXRKDNLKNHXXXHXXXXXXXCXXCXXXXXDPGALVRHXXXHXXXXXXXCXXCXXXXXQAGHLASHXXXHXXXXXXXCXXCXXXXXRSDKLVRHXXXHXXXXXXXXXXX

SEQ ID NO: 2102 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDNLVRHXXXHXXXXXXXCXXCXXXXXSRRTCRAHXXXHXXXXXXXCXXCXXXXXDCRDLARHXXXHXXXXXXXCXXCXXXXXHRTTLTNHXXXHXXXXXXXCXXCXXXXXRRDELNVHXXXHXXXXXXXCXXCXXXXXQSGNLTEHXXXHXXXXXXXCXXCXXXXXTSGHLVRHXXXHXXXXXXXXXXX

SEQ ID NO: 2103 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXHRTTLTNHXXXHXXXXXXXCXXCXXXXXRRDELNVHXXXHXXXXXXXCXXCXXXXXQSGNLTEHXXXHXXXXXXXCXXCXXXXXTSGHLVRHXXXHXXXXXXXCXXCXXXXXRKDNLKNHXXXHXXXXXXXCXXCXXXXXDPGALVRHXXXHXXXXXXXCXXCXXXXXQAGHLASHXXXHXXXXXXXXXXX

SEQ ID NO: 2104 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDCRDLARHXXXHXXXXXXXCXXCXXXXXHRTTLTNHXXXHXXXXXXXCXXCXXXXXRRDELNVHXXXHXXXXXXXCXXCXXXXXQSGNLTEHXXXHXXXXXXXCXXCXXXXXTSGHLVRHXXXHXXXXXXXCXXCXXXXXRKDNLKNHXXXHXXXXXXXCXXCXXXXXDPGALVRHXXXHXXXXXXXXXXX

SEQ ID NO: 2105 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSRRTCRAHXXXHXXXXXXXCXXCXXXXXDCRDLARHXXXHXXXXXXXCXXCXXXXXHRTTLTNHXXXHXXXXXXXCXXCXXXXXRRDELNVHXXXHXXXXXXXCXXCXXXXXQSGNLTEHXXXHXXXXXXXCXXCXXXXXTSGHLVRHXXXHXXXXXXXCXXCXXXXXRKDNLKNHXXXHXXXXXXXXXXX

SEQ ID NO: 2106 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGHLVRHXXXHXXXXXXXCXXCXXXXXRKDNLKNHXXXHXXXXXXXCXXCXXXXXDPGALVRHXXXHXXXXXXXCXXCXXXXXQAGHLASHXXXHXXXXXXXCXXCXXXXXRSDKLVRHXXXHXXXXXXXCXXCXXXXXTSGHLVRHXXXHXXXXXXXCXXCXXXXXRSDHLTNHXXXHXXXXXXXXXXX

SEQ ID NO: 2107 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSGNLTEHXXXHXXXXXXXCXXCXXXXXTSGHLVRHXXXHXXXXXXXCXXCXXXXXRKDNLKNHXXXHXXXXXXXCXXCXXXXXDPGALVRHXXXHXXXXXXXCXXCXXXXXQAGHLASHXXXHXXXXXXXCXXCXXXXXRSDKLVRHXXXHXXXXXXXCXXCXXXXXTSGHLVRHXXXHXXXXXXXXXXX

SEQ ID NO: 2108 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGHLVRHXXXHXXXXXXXCXXCXXXXXTTGNLTVHXXXHXXXXXXXCXXCXXXXXDPGNLVRHXXXHXXXXXXXCXXCXXXXXTSGHLVRHXXXHXXXXXXXCXXCXXXXXRSDHLTTHXXXHXXXXXXXCXXCXXXXXTHLDLIRHXXXHXXXXXXXCXXCXXXXXRNDALTEHXXXHXXXXXXXXXXX

SEQ ID NO: 2109 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXQRAHLERHXXXHXXXXXXXCXXCXXXXXTTGALTEHXXXHXXXXXXXCXXCXXXXXRSDHLTTHXXXHXXXXXXXCXXCXXXXXQSGNLTEHXXXHXXXXXXXCXXCXXXXXQAGHLASHXXXHXXXXXXXCXXCXXXXXRSDKLVRHXXXHXXXXXXXXXXX

SEQ ID NO: 2110 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDELVRHXXXHXXXXXXXCXXCXXXXXRSDKLVRHXXXHXXXXXXXCXXCXXXXXQRAHLERHXXXHXXXXXXXCXXCXXXXXTTGALTEHXXXHXXXXXXXCXXCXXXXXRSDHLTTHXXXHXXXXXXXCXXCXXXXXQSGNLTEHXXXHXXXXXXXCXXCXXXXXQAGHLASHXXXHXXXXXXXXXXX

SEQ ID NO: 2111 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDNLVRHXXXHXXXXXXXCXXCXXXXXTSGHLVRHXXXHXXXXXXXCXXCXXXXXRSDELVRHXXXHXXXXXXXCXXCXXXXXRSDKLVRHXXXHXXXXXXXCXXCXXXXXQRAHLERHXXXHXXXXXXXCXXCXXXXXTTGALTEHXXXHXXXXXXXCXXCXXXXXRSDHLTTHXXXHXXXXXXXXXXX

SEQ ID NO: 2112 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGHLVRHXXXHXXXXXXXCXXCXXXXXRSDELVRHXXXHXXXXXXXCXXCXXXXXRSDKLVRHXXXHXXXXXXXCXXCXXXXXQRAHLERHXXXHXXXXXXXCXXCXXXXXTTGALTEHXXXHXXXXXXXCXXCXXXXXRSDHLTTHXXXHXXXXXXXCXXCXXXXXQSGNLTEHXXXHXXXXXXXXXXX

SEQ ID NO: 2113 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXQSGNLTEHXXXHXXXXXXXCXXCXXXXXHRTTLTNHXXXHXXXXXXXCXXCXXXXXRSDELVRHXXXHXXXXXXXCXXCXXXXXRSDHLTTHXXXHXXXXXXXCXXCXXXXXRSDKLVRHXXXHXXXXXXXCXXCXXXXXRSDNLVRHXXXHXXXXXXXXXXX

SEQ ID NO: 2114 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDELVRHXXXHXXXXXXXCXXCXXXXXSKKHLAEHXXXHXXXXXXXCXXCXXXXXRSDELVRHXXXHXXXXXXXCXXCXXXXXQAGHLASHXXXHXXXXXXXCXXCXXXXXQRANLRAHXXXHXXXXXXXCXXCXXXXXDPGALVRHXXXHXXXXXXXCXXCXXXXXRSDHLTNHXXXHXXXXXXXXXXX

SEQ ID NO: 2115 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXHRTTLTNHXXXHXXXXXXXCXXCXXXXXRSDELVRHXXXHXXXXXXXCXXCXXXXXSKKHLAEHXXXHXXXXXXXCXXCXXXXXRSDELVRHXXXHXXXXXXXCXXCXXXXXQAGHLASHXXXHXXXXXXXCXXCXXXXXQRANLRAHXXXHXXXXXXXCXXCXXXXXDPGALVRHXXXHXXXXXXXXXXX

SEQ ID NO: 2116 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGNLTEHXXXHXXXXXXXCXXCXXXXXHRTTLTNHXXXHXXXXXXXCXXCXXXXXRSDELVRHXXXHXXXXXXXCXXCXXXXXSKKHLAEHXXXHXXXXXXXCXXCXXXXXRSDELVRHXXXHXXXXXXXCXXCXXXXXQAGHLASHXXXHXXXXXXXCXXCXXXXXQRANLRAHXXXHXXXXXXXXXXX

SEQ ID NO: 2117 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGNLVRHXXXHXXXXXXXCXXCXXXXXTSGNLTEHXXXHXXXXXXXCXXCXXXXXHRTTLTNHXXXHXXXXXXXCXXCXXXXXRSDELVRHXXXHXXXXXXXCXXCXXXXXSKKHLAEHXXXHXXXXXXXCXXCXXXXXRSDELVRHXXXHXXXXXXXCXXCXXXXXQAGHLASHXXXHXXXXXXXXXXX

SEQ ID NO: 2118 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDCRDLARHXXXHXXXXXXXCXXCXXXXXTSGNLVRHXXXHXXXXXXXCXXCXXXXXTSGNLTEHXXXHXXXXXXXCXXCXXXXXHRTTLTNHXXXHXXXXXXXCXXCXXXXXRSDELVRHXXXHXXXXXXXCXXCXXXXXSKKHLAEHXXXHXXXXXXXCXXCXXXXXRSDELVRHXXXHXXXXXXXXXXX

SEQ ID NO: 2119 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDCRDLARHXXXHXXXXXXXCXXCXXXXXTKNSLTEHXXXHXXXXXXXCXXCXXXXXRRDELNVHXXXHXXXXXXXCXXCXXXXXRRDELNVHXXXHXXXXXXXCXXCXXXXXDPGALVRHXXXHXXXXXXXCXXCXXXXXQAGHLASHXXXHXXXXXXXCXXCXXXXXRNDTLTEHXXXHXXXXXXXXXXX

SEQ ID NO: 2120 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDSGNLRVHXXXHXXXXXXXCXXCXXXXXSPADLTRHXXXHXXXXXXXCXXCXXXXXTSHSLTEHXXXHXXXXXXXCXXCXXXXXQRANLRAHXXXHXXXXXXXCXXCXXXXXRADNLTEHXXXHXXXXXXXCXXCXXXXXERSHLREHXXXHXXXXXXXCXXCXXXXXDPGALVRHXXXHXXXXXXXXXXX

SEQ ID NO: 2121 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXERSHLREHXXXHXXXXXXXCXXCXXXXXDSGNLRVHXXXHXXXXXXXCXXCXXXXXSPADLTRHXXXHXXXXXXXCXXCXXXXXTSHSLTEHXXXHXXXXXXXCXXCXXXXXQRANLRAHXXXHXXXXXXXCXXCXXXXXRADNLTEHXXXHXXXXXXXCXXCXXXXXERSHLREHXXXHXXXXXXXXXXX

SEQ ID NO: 2122 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSGNLTEHXXXHXXXXXXXCXXCXXXXXERSHLREHXXXHXXXXXXXCXXCXXXXXDSGNLRVHXXXHXXXXXXXCXXCXXXXXSPADLTRHXXXHXXXXXXXCXXCXXXXXTSHSLTEHXXXHXXXXXXXCXXCXXXXXQRANLRAHXXXHXXXXXXXCXXCXXXXXRADNLTEHXXXHXXXXXXXXXXX

SEQ ID NO: 2123 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXERSHLREHXXXHXXXXXXXCXXCXXXXXHKNALQNHXXXHXXXXXXXCXXCXXXXXQSSSLVRHXXXHXXXXXXXCXXCXXXXXTSGSLVRHXXXHXXXXXXXCXXCXXXXXQSGDLRRHXXXHXXXXXXXCXXCXXXXXTSHSLTEHXXXHXXXXXXXCXXCXXXXXDCRDLARHXXXHXXXXXXXXXXX

SEQ ID NO: 2124 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSGDLRRHXXXHXXXXXXXCXXCXXXXXTSHSLTEHXXXHXXXXXXXCXXCXXXXXDCRDLARHXXXHXXXXXXXCXXCXXXXXRSDHLTNHXXXHXXXXXXXCXXCXXXXXTSGSLVRHXXXHXXXXXXXCXXCXXXXXQAGHLASHXXXHXXXXXXXCXXCXXXXXRSDKLTEHXXXHXXXXXXXXXXX

SEQ ID NO: 2125 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSPADLTRHXXXHXXXXXXXCXXCXXXXXTSHSLTEHXXXHXXXXXXXCXXCXXXXXQRANLRAHXXXHXXXXXXXCXXCXXXXXRADNLTEHXXXHXXXXXXXCXXCXXXXXERSHLREHXXXHXXXXXXXCXXCXXXXXDPGALVRHXXXHXXXXXXXCXXCXXXXXTSGHLVRHXXXHXXXXXXXXXXX

SEQ ID NO: 2126 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXHKNALQNHXXXHXXXXXXXCXXCXXXXXQSSSLVRHXXXHXXXXXXXCXXCXXXXXTSGSLVRHXXXHXXXXXXXCXXCXXXXXQSGDLRRHXXXHXXXXXXXCXXCXXXXXTSHSLTEHXXXHXXXXXXXCXXCXXXXXDCRDLARHXXXHXXXXXXXCXXCXXXXXRSDHLTNHXXXHXXXXXXXXXXX

SEQ ID NO: 2127 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDKKDLTRHXXXHXXXXXXXCXXCXXXXXERSHLREHXXXHXXXXXXXCXXCXXXXXHKNALQNHXXXHXXXXXXXCXXCXXXXXQSSSLVRHXXXHXXXXXXXCXXCXXXXXTSGSLVRHXXXHXXXXXXXCXXCXXXXXQSGDLRRHXXXHXXXXXXXCXXCXXXXXTSHSLTEHXXXHXXXXXXXXXXX

SEQ ID NO: 2128 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGSLVRHXXXHXXXXXXXCXXCXXXXXQAGHLASHXXXHXXXXXXXCXXCXXXXXRSDKLTEHXXXHXXXXXXXCXXCXXXXXTSGNLTEHXXXHXXXXXXXCXXCXXXXXQSSNLVRHXXXHXXXXXXXCXXCXXXXXTHLDLIRHXXXHXXXXXXXCXXCXXXXXQKSSLIAHXXXHXXXXXXXXXXX

SEQ ID NO: 2129 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSHSLTEHXXXHXXXXXXXCXXCXXXXXDCRDLARHXXXHXXXXXXXCXXCXXXXXRSDHLTNHXXXHXXXXXXXCXXCXXXXXTSGSLVRHXXXHXXXXXXXCXXCXXXXXQAGHLASHXXXHXXXXXXXCXXCXXXXXRSDKLTEHXXXHXXXXXXXCXXCXXXXXTSGNLTEHXXXHXXXXXXXXXXX

SEQ ID NO: 2130 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDCRDLARHXXXHXXXXXXXCXXCXXXXXRSDHLTNHXXXHXXXXXXXCXXCXXXXXTSGSLVRHXXXHXXXXXXXCXXCXXXXXQAGHLASHXXXHXXXXXXXCXXCXXXXXRSDKLTEHXXXHXXXXXXXCXXCXXXXXTSGNLTEHXXXHXXXXXXXCXXCXXXXXQSSNLVRHXXXHXXXXXXXXXXX

SEQ ID NO: 2131 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQRANLRAHXXXHXXXXXXXCXXCXXXXXRADNLTEHXXXHXXXXXXXCXXCXXXXXERSHLREHXXXHXXXXXXXCXXCXXXXXDPGALVRHXXXHXXXXXXXCXXCXXXXXTSGHLVRHXXXHXXXXXXXCXXCXXXXXRNDTLTEHXXXHXXXXXXXCXXCXXXXXDKKDLTRHXXXHXXXXXXXXXXX

SEQ ID NO: 2132 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRADNLTEHXXXHXXXXXXXCXXCXXXXXERSHLREHXXXHXXXXXXXCXXCXXXXXDPGALVRHXXXHXXXXXXXCXXCXXXXXTSGHLVRHXXXHXXXXXXXCXXCXXXXXRNDTLTEHXXXHXXXXXXXCXXCXXXXXDKKDLTRHXXXHXXXXXXXCXXCXXXXXERSHLREHXXXHXXXXXXXXXXX

SEQ ID NO: 2133 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRNDTLTEHXXXHXXXXXXXCXXCXXXXXDKKDLTRHXXXHXXXXXXXCXXCXXXXXERSHLREHXXXHXXXXXXXCXXCXXXXXHKNALQNHXXXHXXXXXXXCXXCXXXXXQSSSLVRHXXXHXXXXXXXCXXCXXXXXTSGSLVRHXXXHXXXXXXXCXXCXXXXXQSGDLRRHXXXHXXXXXXXXXXX

SEQ ID NO: 2134 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXERSHLREHXXXHXXXXXXXCXXCXXXXXDPGALVRHXXXHXXXXXXXCXXCXXXXXTSGHLVRHXXXHXXXXXXXCXXCXXXXXRNDTLTEHXXXHXXXXXXXCXXCXXXXXDKKDLTRHXXXHXXXXXXXCXXCXXXXXERSHLREHXXXHXXXXXXXCXXCXXXXXHKNALQNHXXXHXXXXXXXXXXX

SEQ ID NO: 2135 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGALVRHXXXHXXXXXXXCXXCXXXXXTSGHLVRHXXXHXXXXXXXCXXCXXXXXRNDTLTEHXXXHXXXXXXXCXXCXXXXXDKKDLTRHXXXHXXXXXXXCXXCXXXXXERSHLREHXXXHXXXXXXXCXXCXXXXXHKNALQNHXXXHXXXXXXXCXXCXXXXXQSSSLVRHXXXHXXXXXXXXXXX

SEQ ID NO: 2136 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGSLVRHXXXHXXXXXXXCXXCXXXXXQSGDLRRHXXXHXXXXXXXCXXCXXXXXTSHSLTEHXXXHXXXXXXXCXXCXXXXXDCRDLARHXXXHXXXXXXXCXXCXXXXXRSDHLTNHXXXHXXXXXXXCXXCXXXXXTSGSLVRHXXXHXXXXXXXCXXCXXXXXQAGHLASHXXXHXXXXXXXXXXX

SEQ ID NO: 2137 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSSSLVRHXXXHXXXXXXXCXXCXXXXXTSGSLVRHXXXHXXXXXXXCXXCXXXXXQSGDLRRHXXXHXXXXXXXCXXCXXXXXTSHSLTEHXXXHXXXXXXXCXXCXXXXXDCRDLARHXXXHXXXXXXXCXXCXXXXXRSDHLTNHXXXHXXXXXXXCXXCXXXXXTSGSLVRHXXXHXXXXXXXXXXX

SEQ ID NO: 2138 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGHLVRHXXXHXXXXXXXCXXCXXXXXRNDTLTEHXXXHXXXXXXXCXXCXXXXXDKKDLTRHXXXHXXXXXXXCXXCXXXXXERSHLREHXXXHXXXXXXXCXXCXXXXXHKNALQNHXXXHXXXXXXXCXXCXXXXXQSSSLVRHXXXHXXXXXXXCXXCXXXXXTSGSLVRHXXXHXXXXXXXXXXX

SEQ ID NO: 2139 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXHRTTLTNHXXXHXXXXXXXCXXCXXXXXERSHLREHXXXHXXXXXXXCXXCXXXXXSKKHLAEHXXXHXXXXXXXCXXCXXXXXDPGHLVRHXXXHXXXXXXXCXXCXXXXXREDNLHTHXXXHXXXXXXXCXXCXXXXXHRTTLTNHXXXHXXXXXXXCXXCXXXXXRSDELVRHXXXHXXXXXXXXXXX

SEQ ID NO: 2140 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRADNLTEHXXXHXXXXXXXCXXCXXXXXQRANLRAHXXXHXXXXXXXCXXCXXXXXDSGNLRVHXXXHXXXXXXXCXXCXXXXXDKKDLTRHXXXHXXXXXXXCXXCXXXXXQSSNLVRHXXXHXXXXXXXCXXCXXXXXTSHSLTEHXXXHXXXXXXXCXXCXXXXXRADNLTEHXXXHXXXXXXXXXXX

SEQ ID NO: 2141 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTTGNLTVHXXXHXXXXXXXCXXCXXXXXTSHSLTEHXXXHXXXXXXXCXXCXXXXXRADNLTEHXXXHXXXXXXXCXXCXXXXXQRANLRAHXXXHXXXXXXXCXXCXXXXXDSGNLRVHXXXHXXXXXXXCXXCXXXXXDKKDLTRHXXXHXXXXXXXCXXCXXXXXQSSNLVRHXXXHXXXXXXXXXXX

SEQ ID NO: 2142 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSHSLTEHXXXHXXXXXXXCXXCXXXXXRADNLTEHXXXHXXXXXXXCXXCXXXXXQRANLRAHXXXHXXXXXXXCXXCXXXXXDSGNLRVHXXXHXXXXXXXCXXCXXXXXDKKDLTRHXXXHXXXXXXXCXXCXXXXXQSSNLVRHXXXHXXXXXXXCXXCXXXXXTSHSLTEHXXXHXXXXXXXXXXX

SEQ ID NO: 2143 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKHLAEHXXXHXXXXXXXCXXCXXXXXTTGNLTVHXXXHXXXXXXXCXXCXXXXXTSHSLTEHXXXHXXXXXXXCXXCXXXXXRADNLTEHXXXHXXXXXXXCXXCXXXXXQRANLRAHXXXHXXXXXXXCXXCXXXXXDSGNLRVHXXXHXXXXXXXCXXCXXXXXDKKDLTRHXXXHXXXXXXXXXXX

SEQ ID NO: 2144 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDCRDLARHXXXHXXXXXXXCXXCXXXXXSPADLTRHXXXHXXXXXXXCXXCXXXXXQSGNLTEHXXXHXXXXXXXCXXCXXXXXQSGNLTEHXXXHXXXXXXXCXXCXXXXXDSGNLRVHXXXHXXXXXXXCXXCXXXXXQLAHLRAHXXXHXXXXXXXCXXCXXXXXDCRDLARHXXXHXXXXXXXXXXX

SEQ ID NO: 2145 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQRANLRAHXXXHXXXXXXXCXXCXXXXXDCRDLARHXXXHXXXXXXXCXXCXXXXXSPADLTRHXXXHXXXXXXXCXXCXXXXXQSGNLTEHXXXHXXXXXXXCXXCXXXXXQSGNLTEHXXXHXXXXXXXCXXCXXXXXDSGNLRVHXXXHXXXXXXXCXXCXXXXXQLAHLRAHXXXHXXXXXXXXXXX

SEQ ID NO: 2146 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDSGNLRVHXXXHXXXXXXXCXXCXXXXXHKNALQNHXXXHXXXXXXXCXXCXXXXXRNDTLTEHXXXHXXXXXXXCXXCXXXXXQRAHLERHXXXHXXXXXXXCXXCXXXXXRSDKLVRHXXXHXXXXXXXCXXCXXXXXDPGHLVRHXXXHXXXXXXXCXXCXXXXXDKKDLTRHXXXHXXXXXXXXXXX

SEQ ID NO: 2147 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRADNLTEHXXXHXXXXXXXCXXCXXXXXRSDKLTEHXXXHXXXXXXXCXXCXXXXXSKKHLAEHXXXHXXXXXXXCXXCXXXXXTKNSLTEHXXXHXXXXXXXCXXCXXXXXDKKDLTRHXXXHXXXXXXXCXXCXXXXXSKKHLAEHXXXHXXXXXXXCXXCXXXXXDKKDLTRHXXXHXXXXXXXXXXX

SEQ ID NO: 2148 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTHLDLIRHXXXHXXXXXXXCXXCXXXXXRKDNLKNHXXXHXXXXXXXCXXCXXXXXDCRDLARHXXXHXXXXXXXCXXCXXXXXREDNLHTHXXXHXXXXXXXCXXCXXXXXDPGHLVRHXXXHXXXXXXXCXXCXXXXXQLAHLRAHXXXHXXXXXXXCXXCXXXXXSKKALTEHXXXHXXXXXXXXXXX

SEQ ID NO: 2149 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRKDNLKNHXXXHXXXXXXXCXXCXXXXXDCRDLARHXXXHXXXXXXXCXXCXXXXXREDNLHTHXXXHXXXXXXXCXXCXXXXXDPGHLVRHXXXHXXXXXXXCXXCXXXXXQLAHLRAHXXXHXXXXXXXCXXCXXXXXSKKALTEHXXXHXXXXXXXCXXCXXXXXTTGALTEHXXXHXXXXXXXXXXX

SEQ ID NO: 2150 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQLAHLRAHXXXHXXXXXXXCXXCXXXXXERSHLREHXXXHXXXXXXXCXXCXXXXXSKKHLAEHXXXHXXXXXXXCXXCXXXXXTHLDLIRHXXXHXXXXXXXCXXCXXXXXRKDNLKNHXXXHXXXXXXXCXXCXXXXXDCRDLARHXXXHXXXXXXXCXXCXXXXXREDNLHTHXXXHXXXXXXXXXXX

SEQ ID NO: 2151 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXERSHLREHXXXHXXXXXXXCXXCXXXXXSKKHLAEHXXXHXXXXXXXCXXCXXXXXTHLDLIRHXXXHXXXXXXXCXXCXXXXXRKDNLKNHXXXHXXXXXXXCXXCXXXXXDCRDLARHXXXHXXXXXXXCXXCXXXXXREDNLHTHXXXHXXXXXXXCXXCXXXXXDPGHLVRHXXXHXXXXXXXXXXX

SEQ ID NO: 2152 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDCRDLARHXXXHXXXXXXXCXXCXXXXXREDNLHTHXXXHXXXXXXXCXXCXXXXXDPGHLVRHXXXHXXXXXXXCXXCXXXXXQLAHLRAHXXXHXXXXXXXCXXCXXXXXSKKALTEHXXXHXXXXXXXCXXCXXXXXTTGALTEHXXXHXXXXXXXCXXCXXXXXSKKHLAEHXXXHXXXXXXXXXXX

SEQ ID NO: 2153 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXREDNLHTHXXXHXXXXXXXCXXCXXXXXDPGHLVRHXXXHXXXXXXXCXXCXXXXXQLAHLRAHXXXHXXXXXXXCXXCXXXXXSKKALTEHXXXHXXXXXXXCXXCXXXXXTTGALTEHXXXHXXXXXXXCXXCXXXXXSKKHLAEHXXXHXXXXXXXCXXCXXXXXTSHSLTEHXXXHXXXXXXXXXXX

SEQ ID NO: 2154 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGHLVRHXXXHXXXXXXXCXXCXXXXXQLAHLRAHXXXHXXXXXXXCXXCXXXXXSKKALTEHXXXHXXXXXXXCXXCXXXXXTTGALTEHXXXHXXXXXXXCXXCXXXXXSKKHLAEHXXXHXXXXXXXCXXCXXXXXTSHSLTEHXXXHXXXXXXXCXXCXXXXXTKNSLTEHXXXHXXXXXXXXXXX

SEQ ID NO: 2155 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKALTEHXXXHXXXXXXXCXXCXXXXXTTGALTEHXXXHXXXXXXXCXXCXXXXXSKKHLAEHXXXHXXXXXXXCXXCXXXXXTSHSLTEHXXXHXXXXXXXCXXCXXXXXTKNSLTEHXXXHXXXXXXXCXXCXXXXXRSDNLVRHXXXHXXXXXXXCXXCXXXXXQSGDLRRHXXXHXXXXXXXXXXX

SEQ ID NO: 2156 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQLAHLRAHXXXHXXXXXXXCXXCXXXXXSKKALTEHXXXHXXXXXXXCXXCXXXXXTTGALTEHXXXHXXXXXXXCXXCXXXXXSKKHLAEHXXXHXXXXXXXCXXCXXXXXTSHSLTEHXXXHXXXXXXXCXXCXXXXXTKNSLTEHXXXHXXXXXXXCXXCXXXXXRSDNLVRHXXXHXXXXXXXXXXX

SEQ ID NO: 2157 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTTGALTEHXXXHXXXXXXXCXXCXXXXXSKKHLAEHXXXHXXXXXXXCXXCXXXXXTSHSLTEHXXXHXXXXXXXCXXCXXXXXTKNSLTEHXXXHXXXXXXXCXXCXXXXXRSDNLVRHXXXHXXXXXXXCXXCXXXXXQSGDLRRHXXXHXXXXXXXCXXCXXXXXRNDTLTEHXXXHXXXXXXXXXXX

SEQ ID NO: 2158 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLTEHXXXHXXXXXXXCXXCXXXXXQRAHLERHXXXHXXXXXXXCXXCXXXXXQLAHLRAHXXXHXXXXXXXCXXCXXXXXSKKHLAEHXXXHXXXXXXXCXXCXXXXXTTGALTEHXXXHXXXXXXXCXXCXXXXXTSGNLVRHXXXHXXXXXXXCXXCXXXXXQSGDLRRHXXXHXXXXXXXXXXX

SEQ ID NO: 2159 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTNHXXXHXXXXXXXCXXCXXXXXRSDKLVRHXXXHXXXXXXXCXXCXXXXXTHLDLIRHXXXHXXXXXXXCXXCXXXXXDPGHLVRHXXXHXXXXXXXCXXCXXXXXRSDNLVRHXXXHXXXXXXXCXXCXXXXXQLAHLRAHXXXHXXXXXXXCXXCXXXXXDPGHLVRHXXXHXXXXXXXXXXX

SEQ ID NO: 2160 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXTHLDLIRHXXXHXXXXXXXCXXCXXXXXDPGHLVRHXXXHXXXXXXXCXXCXXXXXRSDNLVRHXXXHXXXXXXXCXXCXXXXXQLAHLRAHXXXHXXXXXXXCXXCXXXXXDPGHLVRHXXXHXXXXXXXCXXCXXXXXQSSNLVRHXXXHXXXXXXXXXXX

SEQ ID NO: 2161 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRADNLTEHXXXHXXXXXXXCXXCXXXXXRSDHLTNHXXXHXXXXXXXCXXCXXXXXRSDHLTNHXXXHXXXXXXXCXXCXXXXXRSDKLVRHXXXHXXXXXXXCXXCXXXXXTHLDLIRHXXXHXXXXXXXCXXCXXXXXDPGHLVRHXXXHXXXXXXXCXXCXXXXXRSDNLVRHXXXHXXXXXXXXXXX

SEQ ID NO: 2162 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTNHXXXHXXXXXXXCXXCXXXXXRSDHLTNHXXXHXXXXXXXCXXCXXXXXRSDKLVRHXXXHXXXXXXXCXXCXXXXXTHLDLIRHXXXHXXXXXXXCXXCXXXXXDPGHLVRHXXXHXXXXXXXCXXCXXXXXRSDNLVRHXXXHXXXXXXXCXXCXXXXXQLAHLRAHXXXHXXXXXXXXXXX

SEQ ID NO: 2163 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGHLVRHXXXHXXXXXXXCXXCXXXXXRSDNLVRHXXXHXXXXXXXCXXCXXXXXRSDHLTTHXXXHXXXXXXXCXXCXXXXXRADNLTEHXXXHXXXXXXXCXXCXXXXXRSDHLTNHXXXHXXXXXXXCXXCXXXXXRSDHLTNHXXXHXXXXXXXCXXCXXXXXRSDKLVRHXXXHXXXXXXXXXXX

SEQ ID NO: 2164 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTTHXXXHXXXXXXXCXXCXXXXXRADNLTEHXXXHXXXXXXXCXXCXXXXXRSDHLTNHXXXHXXXXXXXCXXCXXXXXRSDHLTNHXXXHXXXXXXXCXXCXXXXXRSDKLVRHXXXHXXXXXXXCXXCXXXXXTHLDLIRHXXXHXXXXXXXCXXCXXXXXDPGHLVRHXXXHXXXXXXXXXXX

SEQ ID NO: 2165 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTKNSLTEHXXXHXXXXXXXCXXCXXXXXRSDKLVRHXXXHXXXXXXXCXXCXXXXXRSDKLTEHXXXHXXXXXXXCXXCXXXXXRSDKLVRHXXXHXXXXXXXCXXCXXXXXQRAHLERHXXXHXXXXXXXCXXCXXXXXDPGHLVRHXXXHXXXXXXXCXXCXXXXXRSDNLVRHXXXHXXXXXXXXXXX

SEQ ID NO: 2166 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDNLVRHXXXHXXXXXXXCXXCXXXXXRSDHLTTHXXXHXXXXXXXCXXCXXXXXRADNLTEHXXXHXXXXXXXCXXCXXXXXRSDHLTNHXXXHXXXXXXXCXXCXXXXXRSDHLTNHXXXHXXXXXXXCXXCXXXXXRSDKLVRHXXXHXXXXXXXCXXCXXXXXTHLDLIRHXXXHXXXXXXXXXXX

SEQ ID NO: 2167 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGHLVRHXXXHXXXXXXXCXXCXXXXXRSDNLVRHXXXHXXXXXXXCXXCXXXXXQLAHLRAHXXXHXXXXXXXCXXCXXXXXDPGHLVRHXXXHXXXXXXXCXXCXXXXXQSSNLVRHXXXHXXXXXXXCXXCXXXXXRKDNLKNHXXXHXXXXXXXCXXCXXXXXQAGHLASHXXXHXXXXXXXXXXX

SEQ ID NO: 2168 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTHLDLIRHXXXHXXXXXXXCXXCXXXXXDPGHLVRHXXXHXXXXXXXCXXCXXXXXRSDNLVRHXXXHXXXXXXXCXXCXXXXXQLAHLRAHXXXHXXXXXXXCXXCXXXXXDPGHLVRHXXXHXXXXXXXCXXCXXXXXQSSNLVRHXXXHXXXXXXXCXXCXXXXXRKDNLKNHXXXHXXXXXXXXXXX

SEQ ID NO: 2169 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXRSDKLTEHXXXHXXXXXXXCXXCXXXXXRSDKLVRHXXXHXXXXXXXCXXCXXXXXQRAHLERHXXXHXXXXXXXCXXCXXXXXDPGHLVRHXXXHXXXXXXXCXXCXXXXXRSDNLVRHXXXHXXXXXXXCXXCXXXXXRSDHLTTHXXXHXXXXXXXXXXX

SEQ ID NO: 2170 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLTEHXXXHXXXXXXXCXXCXXXXXRSDKLVRHXXXHXXXXXXXCXXCXXXXXQRAHLERHXXXHXXXXXXXCXXCXXXXXDPGHLVRHXXXHXXXXXXXCXXCXXXXXRSDNLVRHXXXHXXXXXXXCXXCXXXXXRSDHLTTHXXXHXXXXXXXCXXCXXXXXRADNLTEHXXXHXXXXXXXXXXX

SEQ ID NO: 2171 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXQRAHLERHXXXHXXXXXXXCXXCXXXXXDPGHLVRHXXXHXXXXXXXCXXCXXXXXRSDNLVRHXXXHXXXXXXXCXXCXXXXXRSDHLTTHXXXHXXXXXXXCXXCXXXXXRADNLTEHXXXHXXXXXXXCXXCXXXXXRSDHLTNHXXXHXXXXXXXXXXX

SEQ ID NO: 2172 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQRAHLERHXXXHXXXXXXXCXXCXXXXXDPGHLVRHXXXHXXXXXXXCXXCXXXXXRSDNLVRHXXXHXXXXXXXCXXCXXXXXRSDHLTTHXXXHXXXXXXXCXXCXXXXXRADNLTEHXXXHXXXXXXXCXXCXXXXXRSDHLTNHXXXHXXXXXXXCXXCXXXXXRSDHLTNHXXXHXXXXXXXXXXX

SEQ ID NO: 2173 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQLAHLRAHXXXHXXXXXXXCXXCXXXXXDPGHLVRHXXXHXXXXXXXCXXCXXXXXQSSNLVRHXXXHXXXXXXXCXXCXXXXXRKDNLKNHXXXHXXXXXXXCXXCXXXXXQAGHLASHXXXHXXXXXXXCXXCXXXXXTSGSLVRHXXXHXXXXXXXCXXCXXXXXRTDTLRDHXXXHXXXXXXXXXXX

SEQ ID NO: 2174 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGHLVRHXXXHXXXXXXXCXXCXXXXXQSSNLVRHXXXHXXXXXXXCXXCXXXXXRKDNLKNHXXXHXXXXXXXCXXCXXXXXQAGHLASHXXXHXXXXXXXCXXCXXXXXTSGSLVRHXXXHXXXXXXXCXXCXXXXXRTDTLRDHXXXHXXXXXXXCXXCXXXXXRSDHLTNHXXXHXXXXXXXXXXX

SEQ ID NO: 2175 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSSNLVRHXXXHXXXXXXXCXXCXXXXXRKDNLKNHXXXHXXXXXXXCXXCXXXXXQAGHLASHXXXHXXXXXXXCXXCXXXXXTSGSLVRHXXXHXXXXXXXCXXCXXXXXRTDTLRDHXXXHXXXXXXXCXXCXXXXXRSDHLTNHXXXHXXXXXXXCXXCXXXXXRADNLTEHXXXHXXXXXXXXXXX

SEQ ID NO: 2176 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTNHXXXHXXXXXXXCXXCXXXXXDPGHLVRHXXXHXXXXXXXCXXCXXXXXREDNLHTHXXXHXXXXXXXCXXCXXXXXRSDKLVRHXXXHXXXXXXXCXXCXXXXXTSHSLTEHXXXHXXXXXXXCXXCXXXXXHTGHLLEHXXXHXXXXXXXCXXCXXXXXRSDKLVRHXXXHXXXXXXXXXXX

SEQ ID NO: 2177 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTTHXXXHXXXXXXXCXXCXXXXXRSDHLTNHXXXHXXXXXXXCXXCXXXXXDPGHLVRHXXXHXXXXXXXCXXCXXXXXREDNLHTHXXXHXXXXXXXCXXCXXXXXRSDKLVRHXXXHXXXXXXXCXXCXXXXXTSHSLTEHXXXHXXXXXXXCXXCXXXXXHTGHLLEHXXXHXXXXXXXXXXX

SEQ ID NO: 2178 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGHLVRHXXXHXXXXXXXCXXCXXXXXRSDKLVRHXXXHXXXXXXXCXXCXXXXXDPGHLVRHXXXHXXXXXXXCXXCXXXXXRSDNLVRHXXXHXXXXXXXCXXCXXXXXRSDDLVRHXXXHXXXXXXXCXXCXXXXXRSDHLTNHXXXHXXXXXXXCXXCXXXXXRSDKLVRHXXXHXXXXXXXXXXX

SEQ ID NO: 2179 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTTGNLTVHXXXHXXXXXXXCXXCXXXXXRSDNLVRHXXXHXXXXXXXCXXCXXXXXRSDHLTNHXXXHXXXXXXXCXXCXXXXXDPGHLVRHXXXHXXXXXXXCXXCXXXXXQRAHLERHXXXHXXXXXXXCXXCXXXXXSRRTCRAHXXXHXXXXXXXCXXCXXXXXRSDKLTEHXXXHXXXXXXXXXXX

SEQ ID NO: 2180 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRNDALTEHXXXHXXXXXXXCXXCXXXXXQSGDLRRHXXXHXXXXXXXCXXCXXXXXRSDHLTNHXXXHXXXXXXXCXXCXXXXXRSDNLVRHXXXHXXXXXXXCXXCXXXXXQSGDLRRHXXXHXXXXXXXCXXCXXXXXRKDNLKNHXXXHXXXXXXXCXXCXXXXXRSDHLTNHXXXHXXXXXXXXXXX

SEQ ID NO: 2181 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSRRTCRAHXXXHXXXXXXXCXXCXXXXXRSDKLTEHXXXHXXXXXXXCXXCXXXXXRNDTLTEHXXXHXXXXXXXCXXCXXXXXRSDHLTTHXXXHXXXXXXXCXXCXXXXXRSDHLTNHXXXHXXXXXXXCXXCXXXXXDPGHLVRHXXXHXXXXXXXCXXCXXXXXREDNLHTHXXXHXXXXXXXXXXX

SEQ ID NO: 2182 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLTEHXXXHXXXXXXXCXXCXXXXXRNDTLTEHXXXHXXXXXXXCXXCXXXXXRSDHLTTHXXXHXXXXXXXCXXCXXXXXRSDHLTNHXXXHXXXXXXXCXXCXXXXXDPGHLVRHXXXHXXXXXXXCXXCXXXXXREDNLHTHXXXHXXXXXXXCXXCXXXXXRSDKLVRHXXXHXXXXXXXXXXX

SEQ ID NO: 2183 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRNDTLTEHXXXHXXXXXXXCXXCXXXXXRSDHLTTHXXXHXXXXXXXCXXCXXXXXRSDHLTNHXXXHXXXXXXXCXXCXXXXXDPGHLVRHXXXHXXXXXXXCXXCXXXXXREDNLHTHXXXHXXXXXXXCXXCXXXXXRSDKLVRHXXXHXXXXXXXCXXCXXXXXTSHSLTEHXXXHXXXXXXXXXXX

SEQ ID NO: 2184 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLTEHXXXHXXXXXXXCXXCXXXXXTTGALTEHXXXHXXXXXXXCXXCXXXXXDPGHLVRHXXXHXXXXXXXCXXCXXXXXRSDKLVRHXXXHXXXXXXXCXXCXXXXXDPGHLVRHXXXHXXXXXXXCXXCXXXXXRSDNLVRHXXXHXXXXXXXCXXCXXXXXRSDDLVRHXXXHXXXXXXXXXXX

SEQ ID NO: 2185 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSGDLRRHXXXHXXXXXXXCXXCXXXXXRSDHLTNHXXXHXXXXXXXCXXCXXXXXRSDNLVRHXXXHXXXXXXXCXXCXXXXXQSGDLRRHXXXHXXXXXXXCXXCXXXXXRKDNLKNHXXXHXXXXXXXCXXCXXXXXRSDHLTNHXXXHXXXXXXXCXXCXXXXXQSSNLVRHXXXHXXXXXXXXXXX

SEQ ID NO: 2186 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGHLVRHXXXHXXXXXXXCXXCXXXXXRSDNLVRHXXXHXXXXXXXCXXCXXXXXRSDDLVRHXXXHXXXXXXXCXXCXXXXXRSDHLTNHXXXHXXXXXXXCXXCXXXXXRSDKLVRHXXXHXXXXXXXCXXCXXXXXHRTTLTNHXXXHXXXXXXXCXXCXXXXXDPGHLVRHXXXHXXXXXXXXXXX

SEQ ID NO: 2187 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXDPGHLVRHXXXHXXXXXXXCXXCXXXXXRSDNLVRHXXXHXXXXXXXCXXCXXXXXRSDDLVRHXXXHXXXXXXXCXXCXXXXXRSDHLTNHXXXHXXXXXXXCXXCXXXXXRSDKLVRHXXXHXXXXXXXCXXCXXXXXHRTTLTNHXXXHXXXXXXXXXXX

SEQ ID NO: 2188 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTTGALTEHXXXHXXXXXXXCXXCXXXXXDPGHLVRHXXXHXXXXXXXCXXCXXXXXRSDKLVRHXXXHXXXXXXXCXXCXXXXXDPGHLVRHXXXHXXXXXXXCXXCXXXXXRSDNLVRHXXXHXXXXXXXCXXCXXXXXRSDDLVRHXXXHXXXXXXXCXXCXXXXXRSDHLTNHXXXHXXXXXXXXXXX

SEQ ID NO: 2189 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQRAHLERHXXXHXXXXXXXCXXCXXXXXRNDALTEHXXXHXXXXXXXCXXCXXXXXQSGDLRRHXXXHXXXXXXXCXXCXXXXXRSDHLTNHXXXHXXXXXXXCXXCXXXXXRSDNLVRHXXXHXXXXXXXCXXCXXXXXQSGDLRRHXXXHXXXXXXXCXXCXXXXXRKDNLKNHXXXHXXXXXXXXXXX

SEQ ID NO: 2190 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDDLVRHXXXHXXXXXXXCXXCXXXXXTTGNLTVHXXXHXXXXXXXCXXCXXXXXRSDNLVRHXXXHXXXXXXXCXXCXXXXXRSDHLTNHXXXHXXXXXXXCXXCXXXXXDPGHLVRHXXXHXXXXXXXCXXCXXXXXQRAHLERHXXXHXXXXXXXCXXCXXXXXSRRTCRAHXXXHXXXXXXXXXXX

SEQ ID NO: 2191 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQRAHLERHXXXHXXXXXXXCXXCXXXXXQRAHLERHXXXHXXXXXXXCXXCXXXXXRNDALTEHXXXHXXXXXXXCXXCXXXXXQSGDLRRHXXXHXXXXXXXCXXCXXXXXRSDHLTNHXXXHXXXXXXXCXXCXXXXXRSDNLVRHXXXHXXXXXXXCXXCXXXXXQSGDLRRHXXXHXXXXXXXXXXX

SEQ ID NO: 2192 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGHLVRHXXXHXXXXXXXCXXCXXXXXQRAHLERHXXXHXXXXXXXCXXCXXXXXQRAHLERHXXXHXXXXXXXCXXCXXXXXRNDALTEHXXXHXXXXXXXCXXCXXXXXQSGDLRRHXXXHXXXXXXXCXXCXXXXXRSDHLTNHXXXHXXXXXXXCXXCXXXXXRSDNLVRHXXXHXXXXXXXXXXX

SEQ ID NO: 2193 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGHLVRHXXXHXXXXXXXCXXCXXXXXQRAHLERHXXXHXXXXXXXCXXCXXXXXSRRTCRAHXXXHXXXXXXXCXXCXXXXXRSDKLTEHXXXHXXXXXXXCXXCXXXXXRNDTLTEHXXXHXXXXXXXCXXCXXXXXRSDHLTTHXXXHXXXXXXXCXXCXXXXXRSDHLTNHXXXHXXXXXXXXXXX

SEQ ID NO: 2194 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTNHXXXHXXXXXXXCXXCXXXXXDPGHLVRHXXXHXXXXXXXCXXCXXXXXQRAHLERHXXXHXXXXXXXCXXCXXXXXSRRTCRAHXXXHXXXXXXXCXXCXXXXXRSDKLTEHXXXHXXXXXXXCXXCXXXXXRNDTLTEHXXXHXXXXXXXCXXCXXXXXRSDHLTTHXXXHXXXXXXXXXXX

SEQ ID NO: 2195 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQRAHLERHXXXHXXXXXXXCXXCXXXXXSRRTCRAHXXXHXXXXXXXCXXCXXXXXRSDKLTEHXXXHXXXXXXXCXXCXXXXXRNDTLTEHXXXHXXXXXXXCXXCXXXXXRSDHLTTHXXXHXXXXXXXCXXCXXXXXRSDHLTNHXXXHXXXXXXXCXXCXXXXXDPGHLVRHXXXHXXXXXXXXXXX

SEQ ID NO: 2196 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTHLDLIRHXXXHXXXXXXXCXXCXXXXXRSDDLVRHXXXHXXXXXXXCXXCXXXXXTTGNLTVHXXXHXXXXXXXCXXCXXXXXRSDNLVRHXXXHXXXXXXXCXXCXXXXXRSDHLTNHXXXHXXXXXXXCXXCXXXXXDPGHLVRHXXXHXXXXXXXCXXCXXXXXQRAHLERHXXXHXXXXXXXXXXX

SEQ ID NO: 2197 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXHRTTLTNHXXXHXXXXXXXCXXCXXXXXDPGHLVRHXXXHXXXXXXXCXXCXXXXXQRAHLERHXXXHXXXXXXXCXXCXXXXXQRAHLERHXXXHXXXXXXXCXXCXXXXXRNDALTEHXXXHXXXXXXXCXXCXXXXXQSGDLRRHXXXHXXXXXXXXXXX

SEQ ID NO: 2198 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDNLVRHXXXHXXXXXXXCXXCXXXXXRSDDLVRHXXXHXXXXXXXCXXCXXXXXRSDHLTNHXXXHXXXXXXXCXXCXXXXXRSDKLVRHXXXHXXXXXXXCXXCXXXXXHRTTLTNHXXXHXXXXXXXCXXCXXXXXDPGHLVRHXXXHXXXXXXXCXXCXXXXXQRAHLERHXXXHXXXXXXXXXXX

SEQ ID NO: 2199 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXHRTTLTNHXXXHXXXXXXXCXXCXXXXXDPGHLVRHXXXHXXXXXXXCXXCXXXXXQRAHLERHXXXHXXXXXXXCXXCXXXXXQRAHLERHXXXHXXXXXXXCXXCXXXXXRNDALTEHXXXHXXXXXXXCXXCXXXXXQSGDLRRHXXXHXXXXXXXCXXCXXXXXRSDHLTNHXXXHXXXXXXXXXXX

SEQ ID NO: 2200 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTNHXXXHXXXXXXXCXXCXXXXXRSDKLVRHXXXHXXXXXXXCXXCXXXXXHRTTLTNHXXXHXXXXXXXCXXCXXXXXDPGHLVRHXXXHXXXXXXXCXXCXXXXXQRAHLERHXXXHXXXXXXXCXXCXXXXXQRAHLERHXXXHXXXXXXXCXXCXXXXXRNDALTEHXXXHXXXXXXXXXXX

SEQ ID NO: 2201 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGHLVRHXXXHXXXXXXXCXXCXXXXXREDNLHTHXXXHXXXXXXXCXXCXXXXXRSDKLVRHXXXHXXXXXXXCXXCXXXXXTSHSLTEHXXXHXXXXXXXCXXCXXXXXHTGHLLEHXXXHXXXXXXXCXXCXXXXXRSDKLVRHXXXHXXXXXXXCXXCXXXXXTSGHLVRHXXXHXXXXXXXXXXX

SEQ ID NO: 2202 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXREDNLHTHXXXHXXXXXXXCXXCXXXXXRSDKLVRHXXXHXXXXXXXCXXCXXXXXTSHSLTEHXXXHXXXXXXXCXXCXXXXXHTGHLLEHXXXHXXXXXXXCXXCXXXXXRSDKLVRHXXXHXXXXXXXCXXCXXXXXTSGHLVRHXXXHXXXXXXXCXXCXXXXXRSDKLTEHXXXHXXXXXXXXXXX

SEQ ID NO: 2203 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXTSGHLVRHXXXHXXXXXXXCXXCXXXXXRSDKLTEHXXXHXXXXXXXCXXCXXXXXTTGALTEHXXXHXXXXXXXCXXCXXXXXDPGHLVRHXXXHXXXXXXXCXXCXXXXXRSDKLVRHXXXHXXXXXXXCXXCXXXXXDPGHLVRHXXXHXXXXXXXXXXX

SEQ ID NO: 2204 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGHLVRHXXXHXXXXXXXCXXCXXXXXRSDKLTEHXXXHXXXXXXXCXXCXXXXXTTGALTEHXXXHXXXXXXXCXXCXXXXXDPGHLVRHXXXHXXXXXXXCXXCXXXXXRSDKLVRHXXXHXXXXXXXCXXCXXXXXDPGHLVRHXXXHXXXXXXXCXXCXXXXXRSDNLVRHXXXHXXXXXXXXXXX

SEQ ID NO: 2205 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXHTGHLLEHXXXHXXXXXXXCXXCXXXXXRSDKLVRHXXXHXXXXXXXCXXCXXXXXTSGHLVRHXXXHXXXXXXXCXXCXXXXXRSDKLTEHXXXHXXXXXXXCXXCXXXXXTTGALTEHXXXHXXXXXXXCXXCXXXXXDPGHLVRHXXXHXXXXXXXCXXCXXXXXRSDKLVRHXXXHXXXXXXXXXXX

SEQ ID NO: 2206 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDDLVRHXXXHXXXXXXXCXXCXXXXXRSDHLTNHXXXHXXXXXXXCXXCXXXXXRSDKLVRHXXXHXXXXXXXCXXCXXXXXHRTTLTNHXXXHXXXXXXXCXXCXXXXXDPGHLVRHXXXHXXXXXXXCXXCXXXXXQRAHLERHXXXHXXXXXXXCXXCXXXXXQRAHLERHXXXHXXXXXXXXXXX

SEQ ID NO: 2207 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSHSLTEHXXXHXXXXXXXCXXCXXXXXHTGHLLEHXXXHXXXXXXXCXXCXXXXXRSDKLVRHXXXHXXXXXXXCXXCXXXXXTSGHLVRHXXXHXXXXXXXCXXCXXXXXRSDKLTEHXXXHXXXXXXXCXXCXXXXXTTGALTEHXXXHXXXXXXXCXXCXXXXXDPGHLVRHXXXHXXXXXXXXXXX

SEQ ID NO: 2208 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXTSHSLTEHXXXHXXXXXXXCXXCXXXXXHTGHLLEHXXXHXXXXXXXCXXCXXXXXRSDKLVRHXXXHXXXXXXXCXXCXXXXXTSGHLVRHXXXHXXXXXXXCXXCXXXXXRSDKLTEHXXXHXXXXXXXCXXCXXXXXTTGALTEHXXXHXXXXXXXXXXX

SEQ ID NO: 2209 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDNLVRHXXXHXXXXXXXCXXCXXXXXRSDNLVRHXXXHXXXXXXXCXXCXXXXXRSDHLTTHXXXHXXXXXXXCXXCXXXXXSKKALTEHXXXHXXXXXXXCXXCXXXXXRSDKLVRHXXXHXXXXXXXCXXCXXXXXQLAHLRAHXXXHXXXXXXXCXXCXXXXXRADNLTEHXXXHXXXXXXXXXXX

SEQ ID NO: 2210 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSGDLRRHXXXHXXXXXXXCXXCXXXXXRSDNLVRHXXXHXXXXXXXCXXCXXXXXRSDNLVRHXXXHXXXXXXXCXXCXXXXXRSDHLTTHXXXHXXXXXXXCXXCXXXXXSKKALTEHXXXHXXXXXXXCXXCXXXXXRSDKLVRHXXXHXXXXXXXCXXCXXXXXQLAHLRAHXXXHXXXXXXXXXXX

SEQ ID NO: 2211 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDELVRHXXXHXXXXXXXCXXCXXXXXQSGDLRRHXXXHXXXXXXXCXXCXXXXXRSDNLVRHXXXHXXXXXXXCXXCXXXXXRSDNLVRHXXXHXXXXXXXCXXCXXXXXRSDHLTTHXXXHXXXXXXXCXXCXXXXXSKKALTEHXXXHXXXXXXXCXXCXXXXXRSDKLVRHXXXHXXXXXXXXXXX

SEQ ID NO: 2212 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDNLVRHXXXHXXXXXXXCXXCXXXXXRSDHLTTHXXXHXXXXXXXCXXCXXXXXSKKALTEHXXXHXXXXXXXCXXCXXXXXRSDKLVRHXXXHXXXXXXXCXXCXXXXXQLAHLRAHXXXHXXXXXXXCXXCXXXXXRADNLTEHXXXHXXXXXXXCXXCXXXXXRSDHLTNHXXXHXXXXXXXXXXX

SEQ ID NO: 2213 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLTEHXXXHXXXXXXXCXXCXXXXXRSDKLVRHXXXHXXXXXXXCXXCXXXXXQRAHLERHXXXHXXXXXXXCXXCXXXXXRSDELVRHXXXHXXXXXXXCXXCXXXXXQSGDLRRHXXXHXXXXXXXCXXCXXXXXRSDNLVRHXXXHXXXXXXXCXXCXXXXXRSDNLVRHXXXHXXXXXXXXXXX

SEQ ID NO: 2214 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXQRAHLERHXXXHXXXXXXXCXXCXXXXXRSDELVRHXXXHXXXXXXXCXXCXXXXXQSGDLRRHXXXHXXXXXXXCXXCXXXXXRSDNLVRHXXXHXXXXXXXCXXCXXXXXRSDNLVRHXXXHXXXXXXXCXXCXXXXXRSDHLTTHXXXHXXXXXXXXXXX

SEQ ID NO: 2215 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTNHXXXHXXXXXXXCXXCXXXXXRSDKLTEHXXXHXXXXXXXCXXCXXXXXRSDKLVRHXXXHXXXXXXXCXXCXXXXXQRAHLERHXXXHXXXXXXXCXXCXXXXXRSDELVRHXXXHXXXXXXXCXXCXXXXXQSGDLRRHXXXHXXXXXXXCXXCXXXXXRSDNLVRHXXXHXXXXXXXXXXX

SEQ ID NO: 2216 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQRAHLERHXXXHXXXXXXXCXXCXXXXXRSDELVRHXXXHXXXXXXXCXXCXXXXXQSGDLRRHXXXHXXXXXXXCXXCXXXXXRSDNLVRHXXXHXXXXXXXCXXCXXXXXRSDNLVRHXXXHXXXXXXXCXXCXXXXXRSDHLTTHXXXHXXXXXXXCXXCXXXXXSKKALTEHXXXHXXXXXXXXXXX

SEQ ID NO: 2217 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKALTEHXXXHXXXXXXXCXXCXXXXXRSDKLVRHXXXHXXXXXXXCXXCXXXXXQLAHLRAHXXXHXXXXXXXCXXCXXXXXRADNLTEHXXXHXXXXXXXCXXCXXXXXRSDHLTNHXXXHXXXXXXXCXXCXXXXXQRAHLERHXXXHXXXXXXXCXXCXXXXXQRANLRAHXXXHXXXXXXXXXXX

SEQ ID NO: 2218 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTTHXXXHXXXXXXXCXXCXXXXXSKKALTEHXXXHXXXXXXXCXXCXXXXXRSDKLVRHXXXHXXXXXXXCXXCXXXXXQLAHLRAHXXXHXXXXXXXCXXCXXXXXRADNLTEHXXXHXXXXXXXCXXCXXXXXRSDHLTNHXXXHXXXXXXXCXXCXXXXXQRAHLERHXXXHXXXXXXXXXXX

SEQ ID NO: 2219 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXRSDDLVRHXXXHXXXXXXXCXXCXXXXXRSDHLTNHXXXHXXXXXXXCXXCXXXXXRSDKLTEHXXXHXXXXXXXCXXCXXXXXRSDKLVRHXXXHXXXXXXXCXXCXXXXXQRAHLERHXXXHXXXXXXXCXXCXXXXXRSDELVRHXXXHXXXXXXXXXXX

SEQ ID NO: 2220 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDDLVRHXXXHXXXXXXXCXXCXXXXXRSDHLTNHXXXHXXXXXXXCXXCXXXXXRSDKLTEHXXXHXXXXXXXCXXCXXXXXRSDKLVRHXXXHXXXXXXXCXXCXXXXXQRAHLERHXXXHXXXXXXXCXXCXXXXXRSDELVRHXXXHXXXXXXXCXXCXXXXXQSGDLRRHXXXHXXXXXXXXXXX

SEQ ID NO: 2221 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDCRDLARHXXXHXXXXXXXCXXCXXXXXRSDKLVRHXXXHXXXXXXXCXXCXXXXXRSDDLVRHXXXHXXXXXXXCXXCXXXXXRSDHLTNHXXXHXXXXXXXCXXCXXXXXRSDKLTEHXXXHXXXXXXXCXXCXXXXXRSDKLVRHXXXHXXXXXXXCXXCXXXXXQRAHLERHXXXHXXXXXXXXXXX

SEQ ID NO: 2222 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQLAHLRAHXXXHXXXXXXXCXXCXXXXXRSDKLVRHXXXHXXXXXXXCXXCXXXXXQSGDLRRHXXXHXXXXXXXCXXCXXXXXRSDNLVRHXXXHXXXXXXXCXXCXXXXXRSDELVRHXXXHXXXXXXXCXXCXXXXXDPGHLVRHXXXHXXXXXXXCXXCXXXXXHTGHLLEHXXXHXXXXXXXXXXX

SEQ ID NO: 2223 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXQSGDLRRHXXXHXXXXXXXCXXCXXXXXRSDNLVRHXXXHXXXXXXXCXXCXXXXXRSDELVRHXXXHXXXXXXXCXXCXXXXXDPGHLVRHXXXHXXXXXXXCXXCXXXXXHTGHLLEHXXXHXXXXXXXCXXCXXXXXDPGHLVRHXXXHXXXXXXXXXXX

SEQ ID NO: 2224 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRRDELNVHXXXHXXXXXXXCXXCXXXXXQLAHLRAHXXXHXXXXXXXCXXCXXXXXRSDKLVRHXXXHXXXXXXXCXXCXXXXXQSGDLRRHXXXHXXXXXXXCXXCXXXXXRSDNLVRHXXXHXXXXXXXCXXCXXXXXRSDELVRHXXXHXXXXXXXCXXCXXXXXDPGHLVRHXXXHXXXXXXXXXXX

SEQ ID NO: 2225 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSGHLTEHXXXHXXXXXXXCXXCXXXXXRRDELNVHXXXHXXXXXXXCXXCXXXXXQLAHLRAHXXXHXXXXXXXCXXCXXXXXRSDKLVRHXXXHXXXXXXXCXXCXXXXXQSGDLRRHXXXHXXXXXXXCXXCXXXXXRSDNLVRHXXXHXXXXXXXCXXCXXXXXRSDELVRHXXXHXXXXXXXXXXX

SEQ ID NO: 2226 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTNHXXXHXXXXXXXCXXCXXXXXTSGHLVRHXXXHXXXXXXXCXXCXXXXXRADNLTEHXXXHXXXXXXXCXXCXXXXXDCRDLARHXXXHXXXXXXXCXXCXXXXXDPGHLVRHXXXHXXXXXXXCXXCXXXXXRSDELVRHXXXHXXXXXXXCXXCXXXXXRSDKLVRHXXXHXXXXXXXXXXX

SEQ ID NO: 2227 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSGDLRRHXXXHXXXXXXXCXXCXXXXXRSDHLTNHXXXHXXXXXXXCXXCXXXXXTSGHLVRHXXXHXXXXXXXCXXCXXXXXRADNLTEHXXXHXXXXXXXCXXCXXXXXDCRDLARHXXXHXXXXXXXCXXCXXXXXDPGHLVRHXXXHXXXXXXXCXXCXXXXXRSDELVRHXXXHXXXXXXXXXXX

SEQ ID NO: 2228 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDNLVRHXXXHXXXXXXXCXXCXXXXXRSDELVRHXXXHXXXXXXXCXXCXXXXXDPGHLVRHXXXHXXXXXXXCXXCXXXXXHTGHLLEHXXXHXXXXXXXCXXCXXXXXDPGHLVRHXXXHXXXXXXXCXXCXXXXXTSGHLVRHXXXHXXXXXXXCXXCXXXXXQSGDLRRHXXXHXXXXXXXXXXX

SEQ ID NO: 2229 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSGDLRRHXXXHXXXXXXXCXXCXXXXXRSDNLVRHXXXHXXXXXXXCXXCXXXXXRSDELVRHXXXHXXXXXXXCXXCXXXXXDPGHLVRHXXXHXXXXXXXCXXCXXXXXHTGHLLEHXXXHXXXXXXXCXXCXXXXXDPGHLVRHXXXHXXXXXXXCXXCXXXXXTSGHLVRHXXXHXXXXXXXXXXX

SEQ ID NO: 2230 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDELVRHXXXHXXXXXXXCXXCXXXXXDPGHLVRHXXXHXXXXXXXCXXCXXXXXHTGHLLEHXXXHXXXXXXXCXXCXXXXXDPGHLVRHXXXHXXXXXXXCXXCXXXXXTSGHLVRHXXXHXXXXXXXCXXCXXXXXQSGDLRRHXXXHXXXXXXXCXXCXXXXXRSDHLTNHXXXHXXXXXXXXXXX

SEQ ID NO: 2231 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGHLVRHXXXHXXXXXXXCXXCXXXXXTSGHLVRHXXXHXXXXXXXCXXCXXXXXQSGDLRRHXXXHXXXXXXXCXXCXXXXXRSDHLTNHXXXHXXXXXXXCXXCXXXXXTSGHLVRHXXXHXXXXXXXCXXCXXXXXRADNLTEHXXXHXXXXXXXCXXCXXXXXDCRDLARHXXXHXXXXXXXXXXX

SEQ ID NO: 2232 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGHLVRHXXXHXXXXXXXCXXCXXXXXQSGDLRRHXXXHXXXXXXXCXXCXXXXXRSDHLTNHXXXHXXXXXXXCXXCXXXXXTSGHLVRHXXXHXXXXXXXCXXCXXXXXRADNLTEHXXXHXXXXXXXCXXCXXXXXDCRDLARHXXXHXXXXXXXCXXCXXXXXDPGHLVRHXXXHXXXXXXXXXXX

SEQ ID NO: 2233 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXHTGHLLEHXXXHXXXXXXXCXXCXXXXXDPGHLVRHXXXHXXXXXXXCXXCXXXXXTSGHLVRHXXXHXXXXXXXCXXCXXXXXQSGDLRRHXXXHXXXXXXXCXXCXXXXXRSDHLTNHXXXHXXXXXXXCXXCXXXXXTSGHLVRHXXXHXXXXXXXCXXCXXXXXRADNLTEHXXXHXXXXXXXXXXX

SEQ ID NO: 2234 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGHLVRHXXXHXXXXXXXCXXCXXXXXHTGHLLEHXXXHXXXXXXXCXXCXXXXXDPGHLVRHXXXHXXXXXXXCXXCXXXXXTSGHLVRHXXXHXXXXXXXCXXCXXXXXQSGDLRRHXXXHXXXXXXXCXXCXXXXXRSDHLTNHXXXHXXXXXXXCXXCXXXXXTSGHLVRHXXXHXXXXXXXXXXX

SEQ ID NO: 2235 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDDLVRHXXXHXXXXXXXCXXCXXXXXDCRDLARHXXXHXXXXXXXCXXCXXXXXRSDELVRHXXXHXXXXXXXCXXCXXXXXRADNLTEHXXXHXXXXXXXCXXCXXXXXRSDKLVRHXXXHXXXXXXXCXXCXXXXXQSSSLVRHXXXHXXXXXXXCXXCXXXXXRSDHLTNHXXXHXXXXXXXXXXX

SEQ ID NO: 2236 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDCRDLARHXXXHXXXXXXXCXXCXXXXXRSDELVRHXXXHXXXXXXXCXXCXXXXXRADNLTEHXXXHXXXXXXXCXXCXXXXXRSDKLVRHXXXHXXXXXXXCXXCXXXXXQSSSLVRHXXXHXXXXXXXCXXCXXXXXRSDHLTNHXXXHXXXXXXXCXXCXXXXXSKKHLAEHXXXHXXXXXXXXXXX

SEQ ID NO: 2237 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDDLVRHXXXHXXXXXXXCXXCXXXXXRSDDLVRHXXXHXXXXXXXCXXCXXXXXDCRDLARHXXXHXXXXXXXCXXCXXXXXRSDELVRHXXXHXXXXXXXCXXCXXXXXRADNLTEHXXXHXXXXXXXCXXCXXXXXRSDKLVRHXXXHXXXXXXXCXXCXXXXXQSSSLVRHXXXHXXXXXXXXXXX

SEQ ID NO: 2238 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTTHXXXHXXXXXXXCXXCXXXXXRSDDLVRHXXXHXXXXXXXCXXCXXXXXRSDDLVRHXXXHXXXXXXXCXXCXXXXXDCRDLARHXXXHXXXXXXXCXXCXXXXXRSDELVRHXXXHXXXXXXXCXXCXXXXXRADNLTEHXXXHXXXXXXXCXXCXXXXXRSDKLVRHXXXHXXXXXXXXXXX

SEQ ID NO: 2239 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRADNLTEHXXXHXXXXXXXCXXCXXXXXRSDHLTNHXXXHXXXXXXXCXXCXXXXXRSDHLTTHXXXHXXXXXXXCXXCXXXXXRSDDLVRHXXXHXXXXXXXCXXCXXXXXRSDDLVRHXXXHXXXXXXXCXXCXXXXXDCRDLARHXXXHXXXXXXXCXXCXXXXXRSDELVRHXXXHXXXXXXXXXXX

SEQ ID NO: 2240 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTNHXXXHXXXXXXXCXXCXXXXXRSDHLTTHXXXHXXXXXXXCXXCXXXXXRSDDLVRHXXXHXXXXXXXCXXCXXXXXRSDDLVRHXXXHXXXXXXXCXXCXXXXXDCRDLARHXXXHXXXXXXXCXXCXXXXXRSDELVRHXXXHXXXXXXXCXXCXXXXXRADNLTEHXXXHXXXXXXXXXXX

SEQ ID NO: 2241 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDELVRHXXXHXXXXXXXCXXCXXXXXRADNLTEHXXXHXXXXXXXCXXCXXXXXRSDKLVRHXXXHXXXXXXXCXXCXXXXXQSSSLVRHXXXHXXXXXXXCXXCXXXXXRSDHLTNHXXXHXXXXXXXCXXCXXXXXSKKHLAEHXXXHXXXXXXXCXXCXXXXXRSDDLVRHXXXHXXXXXXXXXXX

SEQ ID NO: 2242 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXQSSSLVRHXXXHXXXXXXXCXXCXXXXXRSDHLTNHXXXHXXXXXXXCXXCXXXXXSKKHLAEHXXXHXXXXXXXCXXCXXXXXRSDDLVRHXXXHXXXXXXXCXXCXXXXXRSDHLTTHXXXHXXXXXXXCXXCXXXXXRSDKLVRHXXXHXXXXXXXXXXX

SEQ ID NO: 2243 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRADNLTEHXXXHXXXXXXXCXXCXXXXXRSDKLVRHXXXHXXXXXXXCXXCXXXXXQSSSLVRHXXXHXXXXXXXCXXCXXXXXRSDHLTNHXXXHXXXXXXXCXXCXXXXXSKKHLAEHXXXHXXXXXXXCXXCXXXXXRSDDLVRHXXXHXXXXXXXCXXCXXXXXRSDHLTTHXXXHXXXXXXXXXXX

SEQ ID NO: 2244 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSSNLVRHXXXHXXXXXXXCXXCXXXXXQRAHLERHXXXHXXXXXXXCXXCXXXXXRADNLTEHXXXHXXXXXXXCXXCXXXXXRSDHLTNHXXXHXXXXXXXCXXCXXXXXRSDHLTTHXXXHXXXXXXXCXXCXXXXXRSDDLVRHXXXHXXXXXXXCXXCXXXXXRSDDLVRHXXXHXXXXXXXXXXX

SEQ ID NO: 2245 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQRAHLERHXXXHXXXXXXXCXXCXXXXXRADNLTEHXXXHXXXXXXXCXXCXXXXXRSDHLTNHXXXHXXXXXXXCXXCXXXXXRSDHLTTHXXXHXXXXXXXCXXCXXXXXRSDDLVRHXXXHXXXXXXXCXXCXXXXXRSDDLVRHXXXHXXXXXXXCXXCXXXXXDCRDLARHXXXHXXXXXXXXXXX

SEQ ID NO: 2246 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGNLTEHXXXHXXXXXXXCXXCXXXXXQRAHLERHXXXHXXXXXXXCXXCXXXXXTSGNLTEHXXXHXXXXXXXCXXCXXXXXQSGHLTEHXXXHXXXXXXXCXXCXXXXXSRRTCRAHXXXHXXXXXXXCXXCXXXXXTKNSLTEHXXXHXXXXXXXCXXCXXXXXDSGNLRVHXXXHXXXXXXXXXXX

SEQ ID NO: 2247 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGHLVRHXXXHXXXXXXXCXXCXXXXXTSGNLTEHXXXHXXXXXXXCXXCXXXXXQRAHLERHXXXHXXXXXXXCXXCXXXXXTSGNLTEHXXXHXXXXXXXCXXCXXXXXQSGHLTEHXXXHXXXXXXXCXXCXXXXXSRRTCRAHXXXHXXXXXXXCXXCXXXXXTKNSLTEHXXXHXXXXXXXXXXX

SEQ ID NO: 2248 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRADNLTEHXXXHXXXXXXXCXXCXXXXXQNSTLTEHXXXHXXXXXXXCXXCXXXXXQSGHLTEHXXXHXXXXXXXCXXCXXXXXDPGHLVRHXXXHXXXXXXXCXXCXXXXXTSGNLTEHXXXHXXXXXXXCXXCXXXXXQRAHLERHXXXHXXXXXXXCXXCXXXXXTSGNLTEHXXXHXXXXXXXXXXX

SEQ ID NO: 2249 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQRAHLERHXXXHXXXXXXXCXXCXXXXXTSGNLTEHXXXHXXXXXXXCXXCXXXXXQSGHLTEHXXXHXXXXXXXCXXCXXXXXSRRTCRAHXXXHXXXXXXXCXXCXXXXXTKNSLTEHXXXHXXXXXXXCXXCXXXXXDSGNLRVHXXXHXXXXXXXCXXCXXXXXQSGNLTEHXXXHXXXXXXXXXXX

SEQ ID NO: 2250 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSGHLTEHXXXHXXXXXXXCXXCXXXXXDPGHLVRHXXXHXXXXXXXCXXCXXXXXTSGNLTEHXXXHXXXXXXXCXXCXXXXXQRAHLERHXXXHXXXXXXXCXXCXXXXXTSGNLTEHXXXHXXXXXXXCXXCXXXXXQSGHLTEHXXXHXXXXXXXCXXCXXXXXSRRTCRAHXXXHXXXXXXXXXXX

SEQ ID NO: 2251 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQNSTLTEHXXXHXXXXXXXCXXCXXXXXQSGHLTEHXXXHXXXXXXXCXXCXXXXXDPGHLVRHXXXHXXXXXXXCXXCXXXXXTSGNLTEHXXXHXXXXXXXCXXCXXXXXQRAHLERHXXXHXXXXXXXCXXCXXXXXTSGNLTEHXXXHXXXXXXXCXXCXXXXXQSGHLTEHXXXHXXXXXXXXXXX

SEQ ID NO: 2252 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGNLVRHXXXHXXXXXXXCXXCXXXXXDCRDLARHXXXHXXXXXXXCXXCXXXXXRRDELNVHXXXHXXXXXXXCXXCXXXXXDPGNLVRHXXXHXXXXXXXCXXCXXXXXRRDELNVHXXXHXXXXXXXCXXCXXXXXDPGNLVRHXXXHXXXXXXXCXXCXXXXXDPGALVRHXXXHXXXXXXXXXXX

SEQ ID NO: 2253 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTKNSLTEHXXXHXXXXXXXCXXCXXXXXRADNLTEHXXXHXXXXXXXCXXCXXXXXDKKDLTRHXXXHXXXXXXXCXXCXXXXXRSDHLTTHXXXHXXXXXXXCXXCXXXXXSKKALTEHXXXHXXXXXXXCXXCXXXXXRNDALTEHXXXHXXXXXXXCXXCXXXXXRSDELVRHXXXHXXXXXXXXXXX

SEQ ID NO: 2254 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRADNLTEHXXXHXXXXXXXCXXCXXXXXDKKDLTRHXXXHXXXXXXXCXXCXXXXXRSDHLTTHXXXHXXXXXXXCXXCXXXXXSKKALTEHXXXHXXXXXXXCXXCXXXXXRNDALTEHXXXHXXXXXXXCXXCXXXXXRSDELVRHXXXHXXXXXXXCXXCXXXXXSPADLTRHXXXHXXXXXXXXXXX

SEQ ID NO: 2255 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSPADLTRHXXXHXXXXXXXCXXCXXXXXTKNSLTEHXXXHXXXXXXXCXXCXXXXXRADNLTEHXXXHXXXXXXXCXXCXXXXXDKKDLTRHXXXHXXXXXXXCXXCXXXXXRSDHLTTHXXXHXXXXXXXCXXCXXXXXSKKALTEHXXXHXXXXXXXCXXCXXXXXRNDALTEHXXXHXXXXXXXXXXX

SEQ ID NO: 2256 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSHSLTEHXXXHXXXXXXXCXXCXXXXXSPADLTRHXXXHXXXXXXXCXXCXXXXXTKNSLTEHXXXHXXXXXXXCXXCXXXXXRADNLTEHXXXHXXXXXXXCXXCXXXXXDKKDLTRHXXXHXXXXXXXCXXCXXXXXRSDHLTTHXXXHXXXXXXXCXXCXXXXXSKKALTEHXXXHXXXXXXXXXXX

SEQ ID NO: 2257 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDKKDLTRHXXXHXXXXXXXCXXCXXXXXRSDHLTTHXXXHXXXXXXXCXXCXXXXXSKKALTEHXXXHXXXXXXXCXXCXXXXXRNDALTEHXXXHXXXXXXXCXXCXXXXXRSDELVRHXXXHXXXXXXXCXXCXXXXXSPADLTRHXXXHXXXXXXXCXXCXXXXXTHLDLIRHXXXHXXXXXXXXXXX

SEQ ID NO: 2258 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRNDALTEHXXXHXXXXXXXCXXCXXXXXRSDELVRHXXXHXXXXXXXCXXCXXXXXSPADLTRHXXXHXXXXXXXCXXCXXXXXTHLDLIRHXXXHXXXXXXXCXXCXXXXXRNDTLTEHXXXHXXXXXXXCXXCXXXXXRSDHLTTHXXXHXXXXXXXCXXCXXXXXSPADLTRHXXXHXXXXXXXXXXX

SEQ ID NO: 2259 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDELVRHXXXHXXXXXXXCXXCXXXXXSPADLTRHXXXHXXXXXXXCXXCXXXXXTHLDLIRHXXXHXXXXXXXCXXCXXXXXRNDTLTEHXXXHXXXXXXXCXXCXXXXXRSDHLTTHXXXHXXXXXXXCXXCXXXXXSPADLTRHXXXHXXXXXXXCXXCXXXXXRSDHLTTHXXXHXXXXXXXXXXX

SEQ ID NO: 2260 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTTGNLTVHXXXHXXXXXXXCXXCXXXXXRSDHLTTHXXXHXXXXXXXCXXCXXXXXSKKHLAEHXXXHXXXXXXXCXXCXXXXXTSHSLTEHXXXHXXXXXXXCXXCXXXXXSPADLTRHXXXHXXXXXXXCXXCXXXXXTKNSLTEHXXXHXXXXXXXCXXCXXXXXRADNLTEHXXXHXXXXXXXXXXX

SEQ ID NO: 2261 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSPADLTRHXXXHXXXXXXXCXXCXXXXXTHLDLIRHXXXHXXXXXXXCXXCXXXXXRNDTLTEHXXXHXXXXXXXCXXCXXXXXRSDHLTTHXXXHXXXXXXXCXXCXXXXXSPADLTRHXXXHXXXXXXXCXXCXXXXXRSDHLTTHXXXHXXXXXXXCXXCXXXXXSPADLTRHXXXHXXXXXXXXXXX

SEQ ID NO: 2262 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKHLAEHXXXHXXXXXXXCXXCXXXXXTSHSLTEHXXXHXXXXXXXCXXCXXXXXSPADLTRHXXXHXXXXXXXCXXCXXXXXTKNSLTEHXXXHXXXXXXXCXXCXXXXXRADNLTEHXXXHXXXXXXXCXXCXXXXXDKKDLTRHXXXHXXXXXXXCXXCXXXXXRSDHLTTHXXXHXXXXXXXXXXX

SEQ ID NO: 2263 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTTHXXXHXXXXXXXCXXCXXXXXSKKHLAEHXXXHXXXXXXXCXXCXXXXXTSHSLTEHXXXHXXXXXXXCXXCXXXXXSPADLTRHXXXHXXXXXXXCXXCXXXXXTKNSLTEHXXXHXXXXXXXCXXCXXXXXRADNLTEHXXXHXXXXXXXCXXCXXXXXDKKDLTRHXXXHXXXXXXXXXXX

SEQ ID NO: 2264 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTTHXXXHXXXXXXXCXXCXXXXXSKKALTEHXXXHXXXXXXXCXXCXXXXXRNDALTEHXXXHXXXXXXXCXXCXXXXXRSDELVRHXXXHXXXXXXXCXXCXXXXXSPADLTRHXXXHXXXXXXXCXXCXXXXXTHLDLIRHXXXHXXXXXXXCXXCXXXXXRNDTLTEHXXXHXXXXXXXXXXX

SEQ ID NO: 2265 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKALTEHXXXHXXXXXXXCXXCXXXXXRNDALTEHXXXHXXXXXXXCXXCXXXXXRSDELVRHXXXHXXXXXXXCXXCXXXXXSPADLTRHXXXHXXXXXXXCXXCXXXXXTHLDLIRHXXXHXXXXXXXCXXCXXXXXRNDTLTEHXXXHXXXXXXXCXXCXXXXXRSDHLTTHXXXHXXXXXXXXXXX

SEQ ID NO: 2266 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDCRDLARHXXXHXXXXXXXCXXCXXXXXTSHSLTEHXXXHXXXXXXXCXXCXXXXXDPGNLVRHXXXHXXXXXXXCXXCXXXXXRNDALTEHXXXHXXXXXXXCXXCXXXXXQSGDLRRHXXXHXXXXXXXCXXCXXXXXTSGELVRHXXXHXXXXXXXCXXCXXXXXHRTTLTNHXXXHXXXXXXXXXXX

SEQ ID NO: 2267 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQAGHLASHXXXHXXXXXXXCXXCXXXXXHKNALQNHXXXHXXXXXXXCXXCXXXXXQRAHLERHXXXHXXXXXXXCXXCXXXXXTKNSLTEHXXXHXXXXXXXCXXCXXXXXSKKALTEHXXXHXXXXXXXCXXCXXXXXSKKALTEHXXXHXXXXXXXCXXCXXXXXQNSTLTEHXXXHXXXXXXXXXXX

SEQ ID NO: 2268 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXHKNALQNHXXXHXXXXXXXCXXCXXXXXQRAHLERHXXXHXXXXXXXCXXCXXXXXTKNSLTEHXXXHXXXXXXXCXXCXXXXXSKKALTEHXXXHXXXXXXXCXXCXXXXXSKKALTEHXXXHXXXXXXXCXXCXXXXXQNSTLTEHXXXHXXXXXXXCXXCXXXXXERSHLREHXXXHXXXXXXXXXXX

SEQ ID NO: 2269 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSSNLVRHXXXHXXXXXXXCXXCXXXXXQAGHLASHXXXHXXXXXXXCXXCXXXXXHKNALQNHXXXHXXXXXXXCXXCXXXXXQRAHLERHXXXHXXXXXXXCXXCXXXXXTKNSLTEHXXXHXXXXXXXCXXCXXXXXSKKALTEHXXXHXXXXXXXCXXCXXXXXSKKALTEHXXXHXXXXXXXXXXX

SEQ ID NO: 2270 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTKNSLTEHXXXHXXXXXXXCXXCXXXXXSKKALTEHXXXHXXXXXXXCXXCXXXXXSKKALTEHXXXHXXXXXXXCXXCXXXXXQNSTLTEHXXXHXXXXXXXCXXCXXXXXERSHLREHXXXHXXXXXXXCXXCXXXXXSKKHLAEHXXXHXXXXXXXCXXCXXXXXQRAHLERHXXXHXXXXXXXXXXX

SEQ ID NO: 2271 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQRAHLERHXXXHXXXXXXXCXXCXXXXXTKNSLTEHXXXHXXXXXXXCXXCXXXXXSKKALTEHXXXHXXXXXXXCXXCXXXXXSKKALTEHXXXHXXXXXXXCXXCXXXXXQNSTLTEHXXXHXXXXXXXCXXCXXXXXERSHLREHXXXHXXXXXXXCXXCXXXXXSKKHLAEHXXXHXXXXXXXXXXX

SEQ ID NO: 2272 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKALTEHXXXHXXXXXXXCXXCXXXXXSKKALTEHXXXHXXXXXXXCXXCXXXXXQNSTLTEHXXXHXXXXXXXCXXCXXXXXERSHLREHXXXHXXXXXXXCXXCXXXXXSKKHLAEHXXXHXXXXXXXCXXCXXXXXQRAHLERHXXXHXXXXXXXCXXCXXXXXTHLDLIRHXXXHXXXXXXXXXXX

SEQ ID NO: 2273 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDELVRHXXXHXXXXXXXCXXCXXXXXTSGNLVRHXXXHXXXXXXXCXXCXXXXXQSGDLRRHXXXHXXXXXXXCXXCXXXXXRSDKLVRHXXXHXXXXXXXCXXCXXXXXRSDELVRHXXXHXXXXXXXCXXCXXXXXREDNLHTHXXXHXXXXXXXCXXCXXXXXRSDHLTTHXXXHXXXXXXXXXXX

SEQ ID NO: 2274 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKHLAEHXXXHXXXXXXXCXXCXXXXXRSDELVRHXXXHXXXXXXXCXXCXXXXXTSGNLVRHXXXHXXXXXXXCXXCXXXXXQSGDLRRHXXXHXXXXXXXCXXCXXXXXRSDKLVRHXXXHXXXXXXXCXXCXXXXXRSDELVRHXXXHXXXXXXXCXXCXXXXXREDNLHTHXXXHXXXXXXXXXXX

SEQ ID NO: 2275 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXRSDELVRHXXXHXXXXXXXCXXCXXXXXREDNLHTHXXXHXXXXXXXCXXCXXXXXRSDHLTTHXXXHXXXXXXXCXXCXXXXXQSGNLTEHXXXHXXXXXXXCXXCXXXXXRSDKLVRHXXXHXXXXXXXCXXCXXXXXTSGNLVRHXXXHXXXXXXXXXXX

SEQ ID NO: 2276 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSGDLRRHXXXHXXXXXXXCXXCXXXXXRSDKLVRHXXXHXXXXXXXCXXCXXXXXRSDELVRHXXXHXXXXXXXCXXCXXXXXREDNLHTHXXXHXXXXXXXCXXCXXXXXRSDHLTTHXXXHXXXXXXXCXXCXXXXXQSGNLTEHXXXHXXXXXXXCXXCXXXXXRSDKLVRHXXXHXXXXXXXXXXX

SEQ ID NO: 2277 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGNLVRHXXXHXXXXXXXCXXCXXXXXQSGDLRRHXXXHXXXXXXXCXXCXXXXXRSDKLVRHXXXHXXXXXXXCXXCXXXXXRSDELVRHXXXHXXXXXXXCXXCXXXXXREDNLHTHXXXHXXXXXXXCXXCXXXXXRSDHLTTHXXXHXXXXXXXCXXCXXXXXQSGNLTEHXXXHXXXXXXXXXXX

SEQ ID NO: 2278 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTNHXXXHXXXXXXXCXXCXXXXXSKKHLAEHXXXHXXXXXXXCXXCXXXXXRSDELVRHXXXHXXXXXXXCXXCXXXXXTSGNLVRHXXXHXXXXXXXCXXCXXXXXQSGDLRRHXXXHXXXXXXXCXXCXXXXXRSDKLVRHXXXHXXXXXXXCXXCXXXXXRSDELVRHXXXHXXXXXXXXXXX

SEQ ID NO: 2279 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDELVRHXXXHXXXXXXXCXXCXXXXXREDNLHTHXXXHXXXXXXXCXXCXXXXXRSDHLTTHXXXHXXXXXXXCXXCXXXXXQSGNLTEHXXXHXXXXXXXCXXCXXXXXRSDKLVRHXXXHXXXXXXXCXXCXXXXXTSGNLVRHXXXHXXXXXXXCXXCXXXXXDPGNLVRHXXXHXXXXXXXXXXX

SEQ ID NO: 2280 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXREDNLHTHXXXHXXXXXXXCXXCXXXXXRSDHLTTHXXXHXXXXXXXCXXCXXXXXQSGNLTEHXXXHXXXXXXXCXXCXXXXXRSDKLVRHXXXHXXXXXXXCXXCXXXXXTSGNLVRHXXXHXXXXXXXCXXCXXXXXDPGNLVRHXXXHXXXXXXXCXXCXXXXXTSGSLVRHXXXHXXXXXXXXXXX

SEQ ID NO: 2281 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSGNLTEHXXXHXXXXXXXCXXCXXXXXRSDKLVRHXXXHXXXXXXXCXXCXXXXXTSGNLVRHXXXHXXXXXXXCXXCXXXXXDPGNLVRHXXXHXXXXXXXCXXCXXXXXTSGSLVRHXXXHXXXXXXXCXXCXXXXXTSGHLVRHXXXHXXXXXXXCXXCXXXXXQSGDLRRHXXXHXXXXXXXXXXX

SEQ ID NO: 2282 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTTHXXXHXXXXXXXCXXCXXXXXQSGNLTEHXXXHXXXXXXXCXXCXXXXXRSDKLVRHXXXHXXXXXXXCXXCXXXXXTSGNLVRHXXXHXXXXXXXCXXCXXXXXDPGNLVRHXXXHXXXXXXXCXXCXXXXXTSGSLVRHXXXHXXXXXXXCXXCXXXXXTSGHLVRHXXXHXXXXXXXXXXX

SEQ ID NO: 2283 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQLAHLRAHXXXHXXXXXXXCXXCXXXXXDPGHLVRHXXXHXXXXXXXCXXCXXXXXRSDKLVRHXXXHXXXXXXXCXXCXXXXXTSGHLVRHXXXHXXXXXXXCXXCXXXXXQSSSLVRHXXXHXXXXXXXCXXCXXXXXRRDELNVHXXXHXXXXXXXCXXCXXXXXQSGDLRRHXXXHXXXXXXXXXXX

SEQ ID NO: 2284 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGHLVRHXXXHXXXXXXXCXXCXXXXXRSDKLVRHXXXHXXXXXXXCXXCXXXXXTSGHLVRHXXXHXXXXXXXCXXCXXXXXQSSSLVRHXXXHXXXXXXXCXXCXXXXXRRDELNVHXXXHXXXXXXXCXXCXXXXXQSGDLRRHXXXHXXXXXXXCXXCXXXXXRSDHLTTHXXXHXXXXXXXXXXX

SEQ ID NO: 2285 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGHLVRHXXXHXXXXXXXCXXCXXXXXQSSSLVRHXXXHXXXXXXXCXXCXXXXXRRDELNVHXXXHXXXXXXXCXXCXXXXXQSGDLRRHXXXHXXXXXXXCXXCXXXXXRSDHLTTHXXXHXXXXXXXCXXCXXXXXQSGHLTEHXXXHXXXXXXXCXXCXXXXXQAGHLASHXXXHXXXXXXXXXXX

SEQ ID NO: 2286 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXTSGHLVRHXXXHXXXXXXXCXXCXXXXXQSSSLVRHXXXHXXXXXXXCXXCXXXXXRRDELNVHXXXHXXXXXXXCXXCXXXXXQSGDLRRHXXXHXXXXXXXCXXCXXXXXRSDHLTTHXXXHXXXXXXXCXXCXXXXXQSGHLTEHXXXHXXXXXXXXXXX

SEQ ID NO: 2287 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRADNLTEHXXXHXXXXXXXCXXCXXXXXRSDKLVRHXXXHXXXXXXXCXXCXXXXXRSDHLTTHXXXHXXXXXXXCXXCXXXXXRSDHLTNHXXXHXXXXXXXCXXCXXXXXTSGHLVRHXXXHXXXXXXXCXXCXXXXXTTGNLTVHXXXHXXXXXXXCXXCXXXXXDPGHLVRHXXXHXXXXXXXXXXX

SEQ ID NO: 2288 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXRSDHLTTHXXXHXXXXXXXCXXCXXXXXRSDHLTNHXXXHXXXXXXXCXXCXXXXXTSGHLVRHXXXHXXXXXXXCXXCXXXXXTTGNLTVHXXXHXXXXXXXCXXCXXXXXDPGHLVRHXXXHXXXXXXXCXXCXXXXXRRDELNVHXXXHXXXXXXXXXXX

SEQ ID NO: 2289 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRRDELNVHXXXHXXXXXXXCXXCXXXXXRADNLTEHXXXHXXXXXXXCXXCXXXXXRSDKLVRHXXXHXXXXXXXCXXCXXXXXRSDHLTTHXXXHXXXXXXXCXXCXXXXXRSDHLTNHXXXHXXXXXXXCXXCXXXXXTSGHLVRHXXXHXXXXXXXCXXCXXXXXTTGNLTVHXXXHXXXXXXXXXXX

SEQ ID NO: 2290 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTTHXXXHXXXXXXXCXXCXXXXXRSDHLTNHXXXHXXXXXXXCXXCXXXXXTSGHLVRHXXXHXXXXXXXCXXCXXXXXTTGNLTVHXXXHXXXXXXXCXXCXXXXXDPGHLVRHXXXHXXXXXXXCXXCXXXXXRRDELNVHXXXHXXXXXXXCXXCXXXXXRTDTLRDHXXXHXXXXXXXXXXX

SEQ ID NO: 2291 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXTKNSLTEHXXXHXXXXXXXCXXCXXXXXRSDELVRHXXXHXXXXXXXCXXCXXXXXTSGHLVRHXXXHXXXXXXXCXXCXXXXXQSGDLRRHXXXHXXXXXXXCXXCXXXXXRSDKLVRHXXXHXXXXXXXCXXCXXXXXRSDELVRHXXXHXXXXXXXXXXX

SEQ ID NO: 2292 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTKNSLTEHXXXHXXXXXXXCXXCXXXXXRSDELVRHXXXHXXXXXXXCXXCXXXXXTSGHLVRHXXXHXXXXXXXCXXCXXXXXQSGDLRRHXXXHXXXXXXXCXXCXXXXXRSDKLVRHXXXHXXXXXXXCXXCXXXXXRSDELVRHXXXHXXXXXXXCXXCXXXXXTSHSLTEHXXXHXXXXXXXXXXX

SEQ ID NO: 2293 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDELVRHXXXHXXXXXXXCXXCXXXXXTSGHLVRHXXXHXXXXXXXCXXCXXXXXQSGDLRRHXXXHXXXXXXXCXXCXXXXXRSDKLVRHXXXHXXXXXXXCXXCXXXXXRSDELVRHXXXHXXXXXXXCXXCXXXXXTSHSLTEHXXXHXXXXXXXCXXCXXXXXRSDELVRHXXXHXXXXXXXXXXX

SEQ ID NO: 2294 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSGDLRRHXXXHXXXXXXXCXXCXXXXXRSDKLVRHXXXHXXXXXXXCXXCXXXXXRSDELVRHXXXHXXXXXXXCXXCXXXXXTSHSLTEHXXXHXXXXXXXCXXCXXXXXRSDELVRHXXXHXXXXXXXCXXCXXXXXTSGHLVRHXXXHXXXXXXXCXXCXXXXXTSHSLTEHXXXHXXXXXXXXXXX

SEQ ID NO: 2295 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGHLVRHXXXHXXXXXXXCXXCXXXXXQSGDLRRHXXXHXXXXXXXCXXCXXXXXRSDKLVRHXXXHXXXXXXXCXXCXXXXXRSDELVRHXXXHXXXXXXXCXXCXXXXXTSHSLTEHXXXHXXXXXXXCXXCXXXXXRSDELVRHXXXHXXXXXXXCXXCXXXXXTSGHLVRHXXXHXXXXXXXXXXX

SEQ ID NO: 2296 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKALTEHXXXHXXXXXXXCXXCXXXXXRSDHLTTHXXXHXXXXXXXCXXCXXXXXTTGALTEHXXXHXXXXXXXCXXCXXXXXTSGNLVRHXXXHXXXXXXXCXXCXXXXXQSGDLRRHXXXHXXXXXXXCXXCXXXXXQRAHLERHXXXHXXXXXXXCXXCXXXXXTSHSLTEHXXXHXXXXXXXXXXX

SEQ ID NO: 2297 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTTGALTEHXXXHXXXXXXXCXXCXXXXXTSGNLVRHXXXHXXXXXXXCXXCXXXXXQSGDLRRHXXXHXXXXXXXCXXCXXXXXQRAHLERHXXXHXXXXXXXCXXCXXXXXTSHSLTEHXXXHXXXXXXXCXXCXXXXXTSGHLVRHXXXHXXXXXXXCXXCXXXXXRNDALTEHXXXHXXXXXXXXXXX

SEQ ID NO: 2298 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTTHXXXHXXXXXXXCXXCXXXXXTTGALTEHXXXHXXXXXXXCXXCXXXXXTSGNLVRHXXXHXXXXXXXCXXCXXXXXQSGDLRRHXXXHXXXXXXXCXXCXXXXXQRAHLERHXXXHXXXXXXXCXXCXXXXXTSHSLTEHXXXHXXXXXXXCXXCXXXXXTSGHLVRHXXXHXXXXXXXXXXX

SEQ ID NO: 2299 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTTGNLTVHXXXHXXXXXXXCXXCXXXXXQSGNLTEHXXXHXXXXXXXCXXCXXXXXQKSSLIAHXXXHXXXXXXXCXXCXXXXXRRDELNVHXXXHXXXXXXXCXXCXXXXXQLAHLRAHXXXHXXXXXXXCXXCXXXXXRSDHLTNHXXXHXXXXXXXCXXCXXXXXRSDKLVRHXXXHXXXXXXXXXXX

SEQ ID NO: 2300 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQKSSLIAHXXXHXXXXXXXCXXCXXXXXRRDELNVHXXXHXXXXXXXCXXCXXXXXQLAHLRAHXXXHXXXXXXXCXXCXXXXXRSDHLTNHXXXHXXXXXXXCXXCXXXXXRSDKLVRHXXXHXXXXXXXCXXCXXXXXTSGHLVRHXXXHXXXXXXXCXXCXXXXXRSDHLTTHXXXHXXXXXXXXXXX

SEQ ID NO: 2301 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRRDELNVHXXXHXXXXXXXCXXCXXXXXQLAHLRAHXXXHXXXXXXXCXXCXXXXXRSDHLTNHXXXHXXXXXXXCXXCXXXXXRSDKLVRHXXXHXXXXXXXCXXCXXXXXTSGHLVRHXXXHXXXXXXXCXXCXXXXXRSDHLTTHXXXHXXXXXXXCXXCXXXXXTTGALTEHXXXHXXXXXXXXXXX

SEQ ID NO: 2302 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXTSGHLVRHXXXHXXXXXXXCXXCXXXXXRSDHLTTHXXXHXXXXXXXCXXCXXXXXTTGALTEHXXXHXXXXXXXCXXCXXXXXQSGNLTEHXXXHXXXXXXXCXXCXXXXXTHLDLIRHXXXHXXXXXXXCXXCXXXXXDPGHLVRHXXXHXXXXXXXXXXX

SEQ ID NO: 2303 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGHLVRHXXXHXXXXXXXCXXCXXXXXTTGNLTVHXXXHXXXXXXXCXXCXXXXXQSGNLTEHXXXHXXXXXXXCXXCXXXXXQKSSLIAHXXXHXXXXXXXCXXCXXXXXRRDELNVHXXXHXXXXXXXCXXCXXXXXQLAHLRAHXXXHXXXXXXXCXXCXXXXXRSDHLTNHXXXHXXXXXXXXXXX

SEQ ID NO: 2304 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTNHXXXHXXXXXXXCXXCXXXXXTSGHLVRHXXXHXXXXXXXCXXCXXXXXTTGNLTVHXXXHXXXXXXXCXXCXXXXXQSGNLTEHXXXHXXXXXXXCXXCXXXXXQKSSLIAHXXXHXXXXXXXCXXCXXXXXRRDELNVHXXXHXXXXXXXCXXCXXXXXQLAHLRAHXXXHXXXXXXXXXXX

SEQ ID NO: 2305 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSGNLTEHXXXHXXXXXXXCXXCXXXXXQKSSLIAHXXXHXXXXXXXCXXCXXXXXRRDELNVHXXXHXXXXXXXCXXCXXXXXQLAHLRAHXXXHXXXXXXXCXXCXXXXXRSDHLTNHXXXHXXXXXXXCXXCXXXXXRSDKLVRHXXXHXXXXXXXCXXCXXXXXTSGHLVRHXXXHXXXXXXXXXXX

SEQ ID NO: 2306 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQLAHLRAHXXXHXXXXXXXCXXCXXXXXRSDHLTNHXXXHXXXXXXXCXXCXXXXXRSDKLVRHXXXHXXXXXXXCXXCXXXXXTSGHLVRHXXXHXXXXXXXCXXCXXXXXRSDHLTTHXXXHXXXXXXXCXXCXXXXXTTGALTEHXXXHXXXXXXXCXXCXXXXXQSGNLTEHXXXHXXXXXXXXXXX

SEQ ID NO: 2307 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTNHXXXHXXXXXXXCXXCXXXXXRSDKLVRHXXXHXXXXXXXCXXCXXXXXTSGHLVRHXXXHXXXXXXXCXXCXXXXXRSDHLTTHXXXHXXXXXXXCXXCXXXXXTTGALTEHXXXHXXXXXXXCXXCXXXXXQSGNLTEHXXXHXXXXXXXCXXCXXXXXTHLDLIRHXXXHXXXXXXXXXXX

SEQ ID NO: 2308 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSPADLTRHXXXHXXXXXXXCXXCXXXXXTSGNLVRHXXXHXXXXXXXCXXCXXXXXTTGNLTVHXXXHXXXXXXXCXXCXXXXXRSDNLVRHXXXHXXXXXXXCXXCXXXXXRSDNLVRHXXXHXXXXXXXCXXCXXXXXRSDHLTTHXXXHXXXXXXXCXXCXXXXXRSDKLVRHXXXHXXXXXXXXXXX

SEQ ID NO: 2309 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXREDNLHTHXXXHXXXXXXXCXXCXXXXXRSDHLTTHXXXHXXXXXXXCXXCXXXXXQRANLRAHXXXHXXXXXXXCXXCXXXXXSPADLTRHXXXHXXXXXXXCXXCXXXXXTSGNLVRHXXXHXXXXXXXCXXCXXXXXTTGNLTVHXXXHXXXXXXXCXXCXXXXXRSDNLVRHXXXHXXXXXXXXXXX

SEQ ID NO: 2310 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQRANLRAHXXXHXXXXXXXCXXCXXXXXSPADLTRHXXXHXXXXXXXCXXCXXXXXTSGNLVRHXXXHXXXXXXXCXXCXXXXXTTGNLTVHXXXHXXXXXXXCXXCXXXXXRSDNLVRHXXXHXXXXXXXCXXCXXXXXRSDNLVRHXXXHXXXXXXXCXXCXXXXXRSDHLTTHXXXHXXXXXXXXXXX

SEQ ID NO: 2311 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTTHXXXHXXXXXXXCXXCXXXXXQRANLRAHXXXHXXXXXXXCXXCXXXXXSPADLTRHXXXHXXXXXXXCXXCXXXXXTSGNLVRHXXXHXXXXXXXCXXCXXXXXTTGNLTVHXXXHXXXXXXXCXXCXXXXXRSDNLVRHXXXHXXXXXXXCXXCXXXXXRSDNLVRHXXXHXXXXXXXXXXX

SEQ ID NO: 2312 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGSLVRHXXXHXXXXXXXCXXCXXXXXREDNLHTHXXXHXXXXXXXCXXCXXXXXRSDHLTTHXXXHXXXXXXXCXXCXXXXXQRANLRAHXXXHXXXXXXXCXXCXXXXXSPADLTRHXXXHXXXXXXXCXXCXXXXXTSGNLVRHXXXHXXXXXXXCXXCXXXXXTTGNLTVHXXXHXXXXXXXXXXX

SEQ ID NO: 2313 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTNHXXXHXXXXXXXCXXCXXXXXSKKALTEHXXXHXXXXXXXCXXCXXXXXRADNLTEHXXXHXXXXXXXCXXCXXXXXDPGHLVRHXXXHXXXXXXXCXXCXXXXXSPADLTRHXXXHXXXXXXXCXXCXXXXXTKNSLTEHXXXHXXXXXXXCXXCXXXXXTSGHLVRHXXXHXXXXXXXXXXX

SEQ ID NO: 2314 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRADNLTEHXXXHXXXXXXXCXXCXXXXXDPGHLVRHXXXHXXXXXXXCXXCXXXXXSPADLTRHXXXHXXXXXXXCXXCXXXXXTKNSLTEHXXXHXXXXXXXCXXCXXXXXTSGHLVRHXXXHXXXXXXXCXXCXXXXXTSGSLVRHXXXHXXXXXXXCXXCXXXXXREDNLHTHXXXHXXXXXXXXXXX

SEQ ID NO: 2315 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGHLVRHXXXHXXXXXXXCXXCXXXXXSPADLTRHXXXHXXXXXXXCXXCXXXXXTKNSLTEHXXXHXXXXXXXCXXCXXXXXTSGHLVRHXXXHXXXXXXXCXXCXXXXXTSGSLVRHXXXHXXXXXXXCXXCXXXXXREDNLHTHXXXHXXXXXXXCXXCXXXXXRSDHLTTHXXXHXXXXXXXXXXX

SEQ ID NO: 2316 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSPADLTRHXXXHXXXXXXXCXXCXXXXXTKNSLTEHXXXHXXXXXXXCXXCXXXXXTSGHLVRHXXXHXXXXXXXCXXCXXXXXTSGSLVRHXXXHXXXXXXXCXXCXXXXXREDNLHTHXXXHXXXXXXXCXXCXXXXXRSDHLTTHXXXHXXXXXXXCXXCXXXXXQRANLRAHXXXHXXXXXXXXXXX

SEQ ID NO: 2317 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTKNSLTEHXXXHXXXXXXXCXXCXXXXXTSGHLVRHXXXHXXXXXXXCXXCXXXXXTSGSLVRHXXXHXXXXXXXCXXCXXXXXREDNLHTHXXXHXXXXXXXCXXCXXXXXRSDHLTTHXXXHXXXXXXXCXXCXXXXXQRANLRAHXXXHXXXXXXXCXXCXXXXXSPADLTRHXXXHXXXXXXXXXXX

SEQ ID NO: 2318 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGHLVRHXXXHXXXXXXXCXXCXXXXXTSGSLVRHXXXHXXXXXXXCXXCXXXXXREDNLHTHXXXHXXXXXXXCXXCXXXXXRSDHLTTHXXXHXXXXXXXCXXCXXXXXQRANLRAHXXXHXXXXXXXCXXCXXXXXSPADLTRHXXXHXXXXXXXCXXCXXXXXTSGNLVRHXXXHXXXXXXXXXXX

SEQ ID NO: 2319 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKALTEHXXXHXXXXXXXCXXCXXXXXRADNLTEHXXXHXXXXXXXCXXCXXXXXDPGHLVRHXXXHXXXXXXXCXXCXXXXXSPADLTRHXXXHXXXXXXXCXXCXXXXXTKNSLTEHXXXHXXXXXXXCXXCXXXXXTSGHLVRHXXXHXXXXXXXCXXCXXXXXTSGSLVRHXXXHXXXXXXXXXXX

SEQ ID NO: 2320 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGHLVRHXXXHXXXXXXXCXXCXXXXXSPADLTRHXXXHXXXXXXXCXXCXXXXXERSHLREHXXXHXXXXXXXCXXCXXXXXDCRDLARHXXXHXXXXXXXCXXCXXXXXRADNLTEHXXXHXXXXXXXCXXCXXXXXQNSTLTEHXXXHXXXXXXXCXXCXXXXXDPGALVRHXXXHXXXXXXXXXXX

SEQ ID NO: 2321 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDCRDLARHXXXHXXXXXXXCXXCXXXXXTSGSLVRHXXXHXXXXXXXCXXCXXXXXTSGHLVRHXXXHXXXXXXXCXXCXXXXXSPADLTRHXXXHXXXXXXXCXXCXXXXXERSHLREHXXXHXXXXXXXCXXCXXXXXDCRDLARHXXXHXXXXXXXCXXCXXXXXRADNLTEHXXXHXXXXXXXXXXX

SEQ ID NO: 2322 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGSLVRHXXXHXXXXXXXCXXCXXXXXTSGHLVRHXXXHXXXXXXXCXXCXXXXXSPADLTRHXXXHXXXXXXXCXXCXXXXXERSHLREHXXXHXXXXXXXCXXCXXXXXDCRDLARHXXXHXXXXXXXCXXCXXXXXRADNLTEHXXXHXXXXXXXCXXCXXXXXQNSTLTEHXXXHXXXXXXXXXXX

SEQ ID NO: 2323 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSHSLTEHXXXHXXXXXXXCXXCXXXXXERSHLREHXXXHXXXXXXXCXXCXXXXXQAGHLASHXXXHXXXXXXXCXXCXXXXXRKDNLKNHXXXHXXXXXXXCXXCXXXXXDCRDLARHXXXHXXXXXXXCXXCXXXXXTSGSLVRHXXXHXXXXXXXCXXCXXXXXTSGHLVRHXXXHXXXXXXXXXXX

SEQ ID NO: 2324 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQAGHLASHXXXHXXXXXXXCXXCXXXXXRKDNLKNHXXXHXXXXXXXCXXCXXXXXDCRDLARHXXXHXXXXXXXCXXCXXXXXTSGSLVRHXXXHXXXXXXXCXXCXXXXXTSGHLVRHXXXHXXXXXXXCXXCXXXXXSPADLTRHXXXHXXXXXXXCXXCXXXXXERSHLREHXXXHXXXXXXXXXXX

SEQ ID NO: 2325 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXERSHLREHXXXHXXXXXXXCXXCXXXXXQAGHLASHXXXHXXXXXXXCXXCXXXXXRKDNLKNHXXXHXXXXXXXCXXCXXXXXDCRDLARHXXXHXXXXXXXCXXCXXXXXTSGSLVRHXXXHXXXXXXXCXXCXXXXXTSGHLVRHXXXHXXXXXXXCXXCXXXXXSPADLTRHXXXHXXXXXXXXXXX

SEQ ID NO: 2326 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRKDNLKNHXXXHXXXXXXXCXXCXXXXXDCRDLARHXXXHXXXXXXXCXXCXXXXXTSGSLVRHXXXHXXXXXXXCXXCXXXXXTSGHLVRHXXXHXXXXXXXCXXCXXXXXSPADLTRHXXXHXXXXXXXCXXCXXXXXERSHLREHXXXHXXXXXXXCXXCXXXXXDCRDLARHXXXHXXXXXXXXXXX

SEQ ID NO: 2327 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGNLTEHXXXHXXXXXXXCXXCXXXXXRSDHLTNHXXXHXXXXXXXCXXCXXXXXSKKALTEHXXXHXXXXXXXCXXCXXXXXTSGNLVRHXXXHXXXXXXXCXXCXXXXXHRTTLTNHXXXHXXXXXXXCXXCXXXXXSKKALTEHXXXHXXXXXXXCXXCXXXXXRSDHLTNHXXXHXXXXXXXXXXX

SEQ ID NO: 2328 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKHLAEHXXXHXXXXXXXCXXCXXXXXRSDELVRHXXXHXXXXXXXCXXCXXXXXTSGNLTEHXXXHXXXXXXXCXXCXXXXXDCRDLARHXXXHXXXXXXXCXXCXXXXXQSSNLVRHXXXHXXXXXXXCXXCXXXXXHRTTLTNHXXXHXXXXXXXCXXCXXXXXTSHSLTEHXXXHXXXXXXXXXXX

SEQ ID NO: 2329 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKALTEHXXXHXXXXXXXCXXCXXXXXRSDHLTNHXXXHXXXXXXXCXXCXXXXXSKKHLAEHXXXHXXXXXXXCXXCXXXXXRSDELVRHXXXHXXXXXXXCXXCXXXXXTSGNLTEHXXXHXXXXXXXCXXCXXXXXDCRDLARHXXXHXXXXXXXCXXCXXXXXQSSNLVRHXXXHXXXXXXXXXXX

SEQ ID NO: 2330 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTNHXXXHXXXXXXXCXXCXXXXXSKKHLAEHXXXHXXXXXXXCXXCXXXXXRSDELVRHXXXHXXXXXXXCXXCXXXXXTSGNLTEHXXXHXXXXXXXCXXCXXXXXDCRDLARHXXXHXXXXXXXCXXCXXXXXQSSNLVRHXXXHXXXXXXXCXXCXXXXXHRTTLTNHXXXHXXXXXXXXXXX

SEQ ID NO: 2331 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKALTEHXXXHXXXXXXXCXXCXXXXXTSGNLVRHXXXHXXXXXXXCXXCXXXXXHRTTLTNHXXXHXXXXXXXCXXCXXXXXSKKALTEHXXXHXXXXXXXCXXCXXXXXRSDHLTNHXXXHXXXXXXXCXXCXXXXXSKKHLAEHXXXHXXXXXXXCXXCXXXXXRSDELVRHXXXHXXXXXXXXXXX

SEQ ID NO: 2332 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXHRTTLTNHXXXHXXXXXXXCXXCXXXXXSKKALTEHXXXHXXXXXXXCXXCXXXXXRSDHLTNHXXXHXXXXXXXCXXCXXXXXSKKHLAEHXXXHXXXXXXXCXXCXXXXXRSDELVRHXXXHXXXXXXXCXXCXXXXXTSGNLTEHXXXHXXXXXXXCXXCXXXXXDCRDLARHXXXHXXXXXXXXXXX

SEQ ID NO: 2333 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGNLVRHXXXHXXXXXXXCXXCXXXXXHRTTLTNHXXXHXXXXXXXCXXCXXXXXSKKALTEHXXXHXXXXXXXCXXCXXXXXRSDHLTNHXXXHXXXXXXXCXXCXXXXXSKKHLAEHXXXHXXXXXXXCXXCXXXXXRSDELVRHXXXHXXXXXXXCXXCXXXXXTSGNLTEHXXXHXXXXXXXXXXX

SEQ ID NO: 2334 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTNHXXXHXXXXXXXCXXCXXXXXSKKALTEHXXXHXXXXXXXCXXCXXXXXTSGNLVRHXXXHXXXXXXXCXXCXXXXXHRTTLTNHXXXHXXXXXXXCXXCXXXXXSKKALTEHXXXHXXXXXXXCXXCXXXXXRSDHLTNHXXXHXXXXXXXCXXCXXXXXSKKHLAEHXXXHXXXXXXXXXXX

SEQ ID NO: 2335 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTTGNLTVHXXXHXXXXXXXCXXCXXXXXDCRDLARHXXXHXXXXXXXCXXCXXXXXRSDHLTNHXXXHXXXXXXXCXXCXXXXXQSGDLRRHXXXHXXXXXXXCXXCXXXXXTKNSLTEHXXXHXXXXXXXCXXCXXXXXRSDHLTNHXXXHXXXXXXXCXXCXXXXXRSDKLVRHXXXHXXXXXXXXXXX

SEQ ID NO: 2336 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDCRDLARHXXXHXXXXXXXCXXCXXXXXRSDHLTNHXXXHXXXXXXXCXXCXXXXXQSGDLRRHXXXHXXXXXXXCXXCXXXXXTKNSLTEHXXXHXXXXXXXCXXCXXXXXRSDHLTNHXXXHXXXXXXXCXXCXXXXXRSDKLVRHXXXHXXXXXXXCXXCXXXXXQSSNLVRHXXXHXXXXXXXXXXX

SEQ ID NO: 2337 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXQSSNLVRHXXXHXXXXXXXCXXCXXXXXTSGHLVRHXXXHXXXXXXXCXXCXXXXXRNDALTEHXXXHXXXXXXXCXXCXXXXXHKNALQNHXXXHXXXXXXXCXXCXXXXXDPGHLVRHXXXHXXXXXXXCXXCXXXXXSPADLTRHXXXHXXXXXXXXXXX

SEQ ID NO: 2338 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSGDLRRHXXXHXXXXXXXCXXCXXXXXTKNSLTEHXXXHXXXXXXXCXXCXXXXXRSDHLTNHXXXHXXXXXXXCXXCXXXXXRSDKLVRHXXXHXXXXXXXCXXCXXXXXQSSNLVRHXXXHXXXXXXXCXXCXXXXXTSGHLVRHXXXHXXXXXXXCXXCXXXXXRNDALTEHXXXHXXXXXXXXXXX

SEQ ID NO: 2339 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTKNSLTEHXXXHXXXXXXXCXXCXXXXXRSDHLTNHXXXHXXXXXXXCXXCXXXXXRSDKLVRHXXXHXXXXXXXCXXCXXXXXQSSNLVRHXXXHXXXXXXXCXXCXXXXXTSGHLVRHXXXHXXXXXXXCXXCXXXXXRNDALTEHXXXHXXXXXXXCXXCXXXXXHKNALQNHXXXHXXXXXXXXXXX

SEQ ID NO: 2340 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTNHXXXHXXXXXXXCXXCXXXXXRSDKLVRHXXXHXXXXXXXCXXCXXXXXQSSNLVRHXXXHXXXXXXXCXXCXXXXXTSGHLVRHXXXHXXXXXXXCXXCXXXXXRNDALTEHXXXHXXXXXXXCXXCXXXXXHKNALQNHXXXHXXXXXXXCXXCXXXXXDPGHLVRHXXXHXXXXXXXXXXX

SEQ ID NO: 2341 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTNHXXXHXXXXXXXCXXCXXXXXQSGDLRRHXXXHXXXXXXXCXXCXXXXXTKNSLTEHXXXHXXXXXXXCXXCXXXXXRSDHLTNHXXXHXXXXXXXCXXCXXXXXRSDKLVRHXXXHXXXXXXXCXXCXXXXXQSSNLVRHXXXHXXXXXXXCXXCXXXXXTSGHLVRHXXXHXXXXXXXXXXX

SEQ ID NO: 2342 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXHKNALQNHXXXHXXXXXXXCXXCXXXXXTSHSLTEHXXXHXXXXXXXCXXCXXXXXRSDKLVRHXXXHXXXXXXXCXXCXXXXXQSGNLTEHXXXHXXXXXXXCXXCXXXXXRNDALTEHXXXHXXXXXXXCXXCXXXXXDPGHLVRHXXXHXXXXXXXCXXCXXXXXQRAHLERHXXXHXXXXXXXXXXX

SEQ ID NO: 2343 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXQSGNLTEHXXXHXXXXXXXCXXCXXXXXRNDALTEHXXXHXXXXXXXCXXCXXXXXDPGHLVRHXXXHXXXXXXXCXXCXXXXXQRAHLERHXXXHXXXXXXXCXXCXXXXXRKDNLKNHXXXHXXXXXXXCXXCXXXXXRSDELVRHXXXHXXXXXXXXXXX

SEQ ID NO: 2344 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSGNLTEHXXXHXXXXXXXCXXCXXXXXRNDALTEHXXXHXXXXXXXCXXCXXXXXDPGHLVRHXXXHXXXXXXXCXXCXXXXXQRAHLERHXXXHXXXXXXXCXXCXXXXXRKDNLKNHXXXHXXXXXXXCXXCXXXXXRSDELVRHXXXHXXXXXXXCXXCXXXXXRSDHLTTHXXXHXXXXXXXXXXX

SEQ ID NO: 2345 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSHSLTEHXXXHXXXXXXXCXXCXXXXXRSDKLVRHXXXHXXXXXXXCXXCXXXXXQSGNLTEHXXXHXXXXXXXCXXCXXXXXRNDALTEHXXXHXXXXXXXCXXCXXXXXDPGHLVRHXXXHXXXXXXXCXXCXXXXXQRAHLERHXXXHXXXXXXXCXXCXXXXXRKDNLKNHXXXHXXXXXXXXXXX

SEQ ID NO: 2346 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGHLVRHXXXHXXXXXXXCXXCXXXXXRRDELNVHXXXHXXXXXXXCXXCXXXXXSKKALTEHXXXHXXXXXXXCXXCXXXXXRSDKLVRHXXXHXXXXXXXCXXCXXXXXTKNSLTEHXXXHXXXXXXXCXXCXXXXXRSDELVRHXXXHXXXXXXXCXXCXXXXXTHLDLIRHXXXHXXXXXXXXXXX

SEQ ID NO: 2347 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKALTEHXXXHXXXXXXXCXXCXXXXXTTGALTEHXXXHXXXXXXXCXXCXXXXXRSDKLVRHXXXHXXXXXXXCXXCXXXXXTSGNLTEHXXXHXXXXXXXCXXCXXXXXQSGDLRRHXXXHXXXXXXXCXXCXXXXXRSDHLTTHXXXHXXXXXXXCXXCXXXXXDCRDLARHXXXHXXXXXXXXXXX

SEQ ID NO: 2348 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTKNSLTEHXXXHXXXXXXXCXXCXXXXXQSGNLTEHXXXHXXXXXXXCXXCXXXXXDPGNLVRHXXXHXXXXXXXCXXCXXXXXREDNLHTHXXXHXXXXXXXCXXCXXXXXRNDALTEHXXXHXXXXXXXCXXCXXXXXDPGHLVRHXXXHXXXXXXXCXXCXXXXXTSGELVRHXXXHXXXXXXXXXXX

SEQ ID NO: 2349 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDKKDLTRHXXXHXXXXXXXCXXCXXXXXTKNSLTEHXXXHXXXXXXXCXXCXXXXXQSGNLTEHXXXHXXXXXXXCXXCXXXXXDPGNLVRHXXXHXXXXXXXCXXCXXXXXREDNLHTHXXXHXXXXXXXCXXCXXXXXRNDALTEHXXXHXXXXXXXCXXCXXXXXDPGHLVRHXXXHXXXXXXXXXXX

SEQ ID NO: 2350 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXHKNALQNHXXXHXXXXXXXCXXCXXXXXDKKDLTRHXXXHXXXXXXXCXXCXXXXXTKNSLTEHXXXHXXXXXXXCXXCXXXXXQSGNLTEHXXXHXXXXXXXCXXCXXXXXDPGNLVRHXXXHXXXXXXXCXXCXXXXXREDNLHTHXXXHXXXXXXXCXXCXXXXXRNDALTEHXXXHXXXXXXXXXXX

SEQ ID NO: 2351 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSHSLTEHXXXHXXXXXXXCXXCXXXXXRSDELVRHXXXHXXXXXXXCXXCXXXXXQAGHLASHXXXHXXXXXXXCXXCXXXXXHRTTLTNHXXXHXXXXXXXCXXCXXXXXQSGNLTEHXXXHXXXXXXXCXXCXXXXXSKKHLAEHXXXHXXXXXXXCXXCXXXXXTSHSLTEHXXXHXXXXXXXXXXX

SEQ ID NO: 2352 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRKDNLKNHXXXHXXXXXXXCXXCXXXXXTSHSLTEHXXXHXXXXXXXCXXCXXXXXRSDELVRHXXXHXXXXXXXCXXCXXXXXQAGHLASHXXXHXXXXXXXCXXCXXXXXHRTTLTNHXXXHXXXXXXXCXXCXXXXXQSGNLTEHXXXHXXXXXXXCXXCXXXXXSKKHLAEHXXXHXXXXXXXXXXX

SEQ ID NO: 2353 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDKKDLTRHXXXHXXXXXXXCXXCXXXXXSKKALTEHXXXHXXXXXXXCXXCXXXXXRSDHLTNHXXXHXXXXXXXCXXCXXXXXSKKHLAEHXXXHXXXXXXXCXXCXXXXXQRAHLERHXXXHXXXXXXXCXXCXXXXXTKNSLTEHXXXHXXXXXXXCXXCXXXXXTSGELVRHXXXHXXXXXXXXXXX

SEQ ID NO: 2354 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDCRDLARHXXXHXXXXXXXCXXCXXXXXTKNSLTEHXXXHXXXXXXXCXXCXXXXXSPADLTRHXXXHXXXXXXXCXXCXXXXXDPGHLVRHXXXHXXXXXXXCXXCXXXXXTSHSLTEHXXXHXXXXXXXCXXCXXXXXDPGNLVRHXXXHXXXXXXXCXXCXXXXXRNDALTEHXXXHXXXXXXXXXXX

SEQ ID NO: 2355 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXTKNSLTEHXXXHXXXXXXXCXXCXXXXXSPADLTRHXXXHXXXXXXXCXXCXXXXXDPGHLVRHXXXHXXXXXXXCXXCXXXXXTHLDLIRHXXXHXXXXXXXCXXCXXXXXSKKHLAEHXXXHXXXXXXXCXXCXXXXXDCRDLARHXXXHXXXXXXXXXXX

SEQ ID NO: 2356 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTKNSLTEHXXXHXXXXXXXCXXCXXXXXSPADLTRHXXXHXXXXXXXCXXCXXXXXDPGHLVRHXXXHXXXXXXXCXXCXXXXXTHLDLIRHXXXHXXXXXXXCXXCXXXXXSKKHLAEHXXXHXXXXXXXCXXCXXXXXDCRDLARHXXXHXXXXXXXCXXCXXXXXTKNSLTEHXXXHXXXXXXXXXXX

SEQ ID NO: 2357 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGHLVRHXXXHXXXXXXXCXXCXXXXXTHLDLIRHXXXHXXXXXXXCXXCXXXXXSKKHLAEHXXXHXXXXXXXCXXCXXXXXDCRDLARHXXXHXXXXXXXCXXCXXXXXTKNSLTEHXXXHXXXXXXXCXXCXXXXXSPADLTRHXXXHXXXXXXXCXXCXXXXXDPGHLVRHXXXHXXXXXXXXXXX

SEQ ID NO: 2358 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSPADLTRHXXXHXXXXXXXCXXCXXXXXDPGHLVRHXXXHXXXXXXXCXXCXXXXXTHLDLIRHXXXHXXXXXXXCXXCXXXXXSKKHLAEHXXXHXXXXXXXCXXCXXXXXDCRDLARHXXXHXXXXXXXCXXCXXXXXTKNSLTEHXXXHXXXXXXXCXXCXXXXXSPADLTRHXXXHXXXXXXXXXXX

SEQ ID NO: 2359 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTHLDLIRHXXXHXXXXXXXCXXCXXXXXSKKHLAEHXXXHXXXXXXXCXXCXXXXXDCRDLARHXXXHXXXXXXXCXXCXXXXXTKNSLTEHXXXHXXXXXXXCXXCXXXXXSPADLTRHXXXHXXXXXXXCXXCXXXXXDPGHLVRHXXXHXXXXXXXCXXCXXXXXTSHSLTEHXXXHXXXXXXXXXXX

SEQ ID NO: 2360 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKALTEHXXXHXXXXXXXCXXCXXXXXRSDKLVRHXXXHXXXXXXXCXXCXXXXXTKNSLTEHXXXHXXXXXXXCXXCXXXXXSPADLTRHXXXHXXXXXXXCXXCXXXXXDPGHLVRHXXXHXXXXXXXCXXCXXXXXTHLDLIRHXXXHXXXXXXXCXXCXXXXXSKKHLAEHXXXHXXXXXXXXXXX

SEQ ID NO: 2361 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKHLAEHXXXHXXXXXXXCXXCXXXXXDCRDLARHXXXHXXXXXXXCXXCXXXXXTKNSLTEHXXXHXXXXXXXCXXCXXXXXSPADLTRHXXXHXXXXXXXCXXCXXXXXDPGHLVRHXXXHXXXXXXXCXXCXXXXXTSHSLTEHXXXHXXXXXXXCXXCXXXXXDPGNLVRHXXXHXXXXXXXXXXX

SEQ ID NO: 2362 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSPADLTRHXXXHXXXXXXXCXXCXXXXXDPGHLVRHXXXHXXXXXXXCXXCXXXXXRNDALTEHXXXHXXXXXXXCXXCXXXXXSKKALTEHXXXHXXXXXXXCXXCXXXXXQSGDLRRHXXXHXXXXXXXCXXCXXXXXRNDALTEHXXXHXXXXXXXCXXCXXXXXTSHSLTEHXXXHXXXXXXXXXXX

SEQ ID NO: 2363 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSGDLRRHXXXHXXXXXXXCXXCXXXXXRNDALTEHXXXHXXXXXXXCXXCXXXXXTSHSLTEHXXXHXXXXXXXCXXCXXXXXSKKHLAEHXXXHXXXXXXXCXXCXXXXXRNDALTEHXXXHXXXXXXXCXXCXXXXXSKKALTEHXXXHXXXXXXXCXXCXXXXXQSGDLRRHXXXHXXXXXXXXXXX

SEQ ID NO: 2364 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRNDALTEHXXXHXXXXXXXCXXCXXXXXSKKALTEHXXXHXXXXXXXCXXCXXXXXQSGDLRRHXXXHXXXXXXXCXXCXXXXXRNDALTEHXXXHXXXXXXXCXXCXXXXXTSHSLTEHXXXHXXXXXXXCXXCXXXXXSKKHLAEHXXXHXXXXXXXCXXCXXXXXRNDALTEHXXXHXXXXXXXXXXX

SEQ ID NO: 2365 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGHLVRHXXXHXXXXXXXCXXCXXXXXRNDALTEHXXXHXXXXXXXCXXCXXXXXSKKALTEHXXXHXXXXXXXCXXCXXXXXQSGDLRRHXXXHXXXXXXXCXXCXXXXXRNDALTEHXXXHXXXXXXXCXXCXXXXXTSHSLTEHXXXHXXXXXXXCXXCXXXXXSKKHLAEHXXXHXXXXXXXXXXX

SEQ ID NO: 2366 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRNDALTEHXXXHXXXXXXXCXXCXXXXXTSHSLTEHXXXHXXXXXXXCXXCXXXXXSKKHLAEHXXXHXXXXXXXCXXCXXXXXRNDALTEHXXXHXXXXXXXCXXCXXXXXSKKALTEHXXXHXXXXXXXCXXCXXXXXQSGDLRRHXXXHXXXXXXXCXXCXXXXXRADNLTEHXXXHXXXXXXXXXXX

SEQ ID NO: 2367 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKHLAEHXXXHXXXXXXXCXXCXXXXXRNDALTEHXXXHXXXXXXXCXXCXXXXXSKKALTEHXXXHXXXXXXXCXXCXXXXXQSGDLRRHXXXHXXXXXXXCXXCXXXXXRADNLTEHXXXHXXXXXXXCXXCXXXXXDKKDLTRHXXXHXXXXXXXCXXCXXXXXRSDHLTTHXXXHXXXXXXXXXXX

SEQ ID NO: 2368 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSHSLTEHXXXHXXXXXXXCXXCXXXXXSKKHLAEHXXXHXXXXXXXCXXCXXXXXRNDALTEHXXXHXXXXXXXCXXCXXXXXSKKALTEHXXXHXXXXXXXCXXCXXXXXQSGDLRRHXXXHXXXXXXXCXXCXXXXXRADNLTEHXXXHXXXXXXXCXXCXXXXXDKKDLTRHXXXHXXXXXXXXXXX

SEQ ID NO: 2369 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKALTEHXXXHXXXXXXXCXXCXXXXXQSGDLRRHXXXHXXXXXXXCXXCXXXXXRNDALTEHXXXHXXXXXXXCXXCXXXXXTSHSLTEHXXXHXXXXXXXCXXCXXXXXSKKHLAEHXXXHXXXXXXXCXXCXXXXXRNDALTEHXXXHXXXXXXXCXXCXXXXXSKKALTEHXXXHXXXXXXXXXXX

SEQ ID NO: 2370 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSRRTCRAHXXXHXXXXXXXCXXCXXXXXTSGNLTEHXXXHXXXXXXXCXXCXXXXXDCRDLARHXXXHXXXXXXXCXXCXXXXXHKNALQNHXXXHXXXXXXXCXXCXXXXXDKKDLTRHXXXHXXXXXXXCXXCXXXXXTKNSLTEHXXXHXXXXXXXCXXCXXXXXTSHSLTEHXXXHXXXXXXXXXXX

SEQ ID NO: 2371 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRNDALTEHXXXHXXXXXXXCXXCXXXXXTSGNLTEHXXXHXXXXXXXCXXCXXXXXQSGDLRRHXXXHXXXXXXXCXXCXXXXXRSDHLTTHXXXHXXXXXXXCXXCXXXXXDKKDLTRHXXXHXXXXXXXCXXCXXXXXSKKALTEHXXXHXXXXXXXCXXCXXXXXRSDHLTTHXXXHXXXXXXXXXXX

SEQ ID NO: 2372 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGNLTEHXXXHXXXXXXXCXXCXXXXXQSGDLRRHXXXHXXXXXXXCXXCXXXXXRSDHLTTHXXXHXXXXXXXCXXCXXXXXDKKDLTRHXXXHXXXXXXXCXXCXXXXXSKKALTEHXXXHXXXXXXXCXXCXXXXXRSDHLTTHXXXHXXXXXXXCXXCXXXXXSKKALTEHXXXHXXXXXXXXXXX

SEQ ID NO: 2373 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDCRDLARHXXXHXXXXXXXCXXCXXXXXHKNALQNHXXXHXXXXXXXCXXCXXXXXDKKDLTRHXXXHXXXXXXXCXXCXXXXXTKNSLTEHXXXHXXXXXXXCXXCXXXXXTSHSLTEHXXXHXXXXXXXCXXCXXXXXSKKHLAEHXXXHXXXXXXXCXXCXXXXXRNDALTEHXXXHXXXXXXXXXXX

SEQ ID NO: 2374 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTKNSLTEHXXXHXXXXXXXCXXCXXXXXTSHSLTEHXXXHXXXXXXXCXXCXXXXXSKKHLAEHXXXHXXXXXXXCXXCXXXXXRNDALTEHXXXHXXXXXXXCXXCXXXXXTSGNLTEHXXXHXXXXXXXCXXCXXXXXQSGDLRRHXXXHXXXXXXXCXXCXXXXXRSDHLTTHXXXHXXXXXXXXXXX

SEQ ID NO: 2375 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSHSLTEHXXXHXXXXXXXCXXCXXXXXSKKHLAEHXXXHXXXXXXXCXXCXXXXXRNDALTEHXXXHXXXXXXXCXXCXXXXXTSGNLTEHXXXHXXXXXXXCXXCXXXXXQSGDLRRHXXXHXXXXXXXCXXCXXXXXRSDHLTTHXXXHXXXXXXXCXXCXXXXXDKKDLTRHXXXHXXXXXXXXXXX

SEQ ID NO: 2376 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDKKDLTRHXXXHXXXXXXXCXXCXXXXXTKNSLTEHXXXHXXXXXXXCXXCXXXXXTSHSLTEHXXXHXXXXXXXCXXCXXXXXSKKHLAEHXXXHXXXXXXXCXXCXXXXXRNDALTEHXXXHXXXXXXXCXXCXXXXXTSGNLTEHXXXHXXXXXXXCXXCXXXXXQSGDLRRHXXXHXXXXXXXXXXX

SEQ ID NO: 2377 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSGNLTEHXXXHXXXXXXXCXXCXXXXXSRRTCRAHXXXHXXXXXXXCXXCXXXXXTSGNLTEHXXXHXXXXXXXCXXCXXXXXDCRDLARHXXXHXXXXXXXCXXCXXXXXHKNALQNHXXXHXXXXXXXCXXCXXXXXDKKDLTRHXXXHXXXXXXXCXXCXXXXXTKNSLTEHXXXHXXXXXXXXXXX

SEQ ID NO: 2378 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXHKNALQNHXXXHXXXXXXXCXXCXXXXXDKKDLTRHXXXHXXXXXXXCXXCXXXXXTKNSLTEHXXXHXXXXXXXCXXCXXXXXTSHSLTEHXXXHXXXXXXXCXXCXXXXXSKKHLAEHXXXHXXXXXXXCXXCXXXXXRNDALTEHXXXHXXXXXXXCXXCXXXXXTSGNLTEHXXXHXXXXXXXXXXX

SEQ ID NO: 2379 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSGDLRRHXXXHXXXXXXXCXXCXXXXXRSDHLTTHXXXHXXXXXXXCXXCXXXXXDKKDLTRHXXXHXXXXXXXCXXCXXXXXSKKALTEHXXXHXXXXXXXCXXCXXXXXRSDHLTTHXXXHXXXXXXXCXXCXXXXXSKKALTEHXXXHXXXXXXXCXXCXXXXXSKKHLAEHXXXHXXXXXXXXXXX

SEQ ID NO: 2380 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGNLTEHXXXHXXXXXXXCXXCXXXXXDCRDLARHXXXHXXXXXXXCXXCXXXXXHKNALQNHXXXHXXXXXXXCXXCXXXXXDKKDLTRHXXXHXXXXXXXCXXCXXXXXTKNSLTEHXXXHXXXXXXXCXXCXXXXXTSHSLTEHXXXHXXXXXXXCXXCXXXXXSKKHLAEHXXXHXXXXXXXXXXX

SEQ ID NO: 2381 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKHLAEHXXXHXXXXXXXCXXCXXXXXRNDALTEHXXXHXXXXXXXCXXCXXXXXTSGNLTEHXXXHXXXXXXXCXXCXXXXXQSGDLRRHXXXHXXXXXXXCXXCXXXXXRSDHLTTHXXXHXXXXXXXCXXCXXXXXDKKDLTRHXXXHXXXXXXXCXXCXXXXXSKKALTEHXXXHXXXXXXXXXXX

SEQ ID NO: 2382 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRNDALTEHXXXHXXXXXXXCXXCXXXXXSKKALTEHXXXHXXXXXXXCXXCXXXXXQSGNLTEHXXXHXXXXXXXCXXCXXXXXSRRTCRAHXXXHXXXXXXXCXXCXXXXXTSGNLTEHXXXHXXXXXXXCXXCXXXXXDCRDLARHXXXHXXXXXXXCXXCXXXXXHKNALQNHXXXHXXXXXXXXXXX

SEQ ID NO: 2383 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXHKNALQNHXXXHXXXXXXXCXXCXXXXXSKKALTEHXXXHXXXXXXXCXXCXXXXXRNDALTEHXXXHXXXXXXXCXXCXXXXXSKKALTEHXXXHXXXXXXXCXXCXXXXXQSGNLTEHXXXHXXXXXXXCXXCXXXXXSRRTCRAHXXXHXXXXXXXCXXCXXXXXTSGNLTEHXXXHXXXXXXXXXXX

SEQ ID NO: 2384 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKALTEHXXXHXXXXXXXCXXCXXXXXQSGNLTEHXXXHXXXXXXXCXXCXXXXXSRRTCRAHXXXHXXXXXXXCXXCXXXXXTSGNLTEHXXXHXXXXXXXCXXCXXXXXDCRDLARHXXXHXXXXXXXCXXCXXXXXHKNALQNHXXXHXXXXXXXCXXCXXXXXDKKDLTRHXXXHXXXXXXXXXXX

SEQ ID NO: 2385 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKALTEHXXXHXXXXXXXCXXCXXXXXRNDALTEHXXXHXXXXXXXCXXCXXXXXSKKALTEHXXXHXXXXXXXCXXCXXXXXQSGNLTEHXXXHXXXXXXXCXXCXXXXXSRRTCRAHXXXHXXXXXXXCXXCXXXXXTSGNLTEHXXXHXXXXXXXCXXCXXXXXDCRDLARHXXXHXXXXXXXXXXX

SEQ ID NO: 2386 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGALVRHXXXHXXXXXXXCXXCXXXXXRSDHLTTHXXXHXXXXXXXCXXCXXXXXDPGHLVRHXXXHXXXXXXXCXXCXXXXXQSSSLVRHXXXHXXXXXXXCXXCXXXXXTSGHLVRHXXXHXXXXXXXCXXCXXXXXTSGHLVRHXXXHXXXXXXXCXXCXXXXXRADNLTEHXXXHXXXXXXXXXXX

SEQ ID NO: 2387 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRADNLTEHXXXHXXXXXXXCXXCXXXXXDPGALVRHXXXHXXXXXXXCXXCXXXXXRSDHLTTHXXXHXXXXXXXCXXCXXXXXDPGHLVRHXXXHXXXXXXXCXXCXXXXXQSSSLVRHXXXHXXXXXXXCXXCXXXXXTSGHLVRHXXXHXXXXXXXCXXCXXXXXTSGHLVRHXXXHXXXXXXXXXXX

SEQ ID NO: 2388 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKALTEHXXXHXXXXXXXCXXCXXXXXRADNLTEHXXXHXXXXXXXCXXCXXXXXRSDELVRHXXXHXXXXXXXCXXCXXXXXTSHSLTEHXXXHXXXXXXXCXXCXXXXXTSGHLVRHXXXHXXXXXXXCXXCXXXXXRNDALTEHXXXHXXXXXXXCXXCXXXXXRSDHLTNHXXXHXXXXXXXXXXX

SEQ ID NO: 2389 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGALVRHXXXHXXXXXXXCXXCXXXXXTSGNLTEHXXXHXXXXXXXCXXCXXXXXDPGHLVRHXXXHXXXXXXXCXXCXXXXXDPGALVRHXXXHXXXXXXXCXXCXXXXXQSSSLVRHXXXHXXXXXXXCXXCXXXXXTHLDLIRHXXXHXXXXXXXCXXCXXXXXERSHLREHXXXHXXXXXXXXXXX

SEQ ID NO: 2390 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGNLTEHXXXHXXXXXXXCXXCXXXXXDPGALVRHXXXHXXXXXXXCXXCXXXXXTSGNLTEHXXXHXXXXXXXCXXCXXXXXDPGHLVRHXXXHXXXXXXXCXXCXXXXXDPGALVRHXXXHXXXXXXXCXXCXXXXXQSSSLVRHXXXHXXXXXXXCXXCXXXXXTHLDLIRHXXXHXXXXXXXXXXX

SEQ ID NO: 2391 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGALVRHXXXHXXXXXXXCXXCXXXXXTSGNLTEHXXXHXXXXXXXCXXCXXXXXDPGALVRHXXXHXXXXXXXCXXCXXXXXTSGNLTEHXXXHXXXXXXXCXXCXXXXXDPGHLVRHXXXHXXXXXXXCXXCXXXXXDPGALVRHXXXHXXXXXXXCXXCXXXXXQSSSLVRHXXXHXXXXXXXXXXX

SEQ ID NO: 2392 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGNLVRHXXXHXXXXXXXCXXCXXXXXDPGALVRHXXXHXXXXXXXCXXCXXXXXTSGNLTEHXXXHXXXXXXXCXXCXXXXXDPGALVRHXXXHXXXXXXXCXXCXXXXXTSGNLTEHXXXHXXXXXXXCXXCXXXXXDPGHLVRHXXXHXXXXXXXCXXCXXXXXDPGALVRHXXXHXXXXXXXXXXX

SEQ ID NO: 2393 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDNLVRHXXXHXXXXXXXCXXCXXXXXDPGNLVRHXXXHXXXXXXXCXXCXXXXXDPGALVRHXXXHXXXXXXXCXXCXXXXXTSGNLTEHXXXHXXXXXXXCXXCXXXXXDPGALVRHXXXHXXXXXXXCXXCXXXXXTSGNLTEHXXXHXXXXXXXCXXCXXXXXDPGHLVRHXXXHXXXXXXXXXXX

SEQ ID NO: 2394 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGHLVRHXXXHXXXXXXXCXXCXXXXXRSDNLVRHXXXHXXXXXXXCXXCXXXXXDPGNLVRHXXXHXXXXXXXCXXCXXXXXDPGALVRHXXXHXXXXXXXCXXCXXXXXTSGNLTEHXXXHXXXXXXXCXXCXXXXXDPGALVRHXXXHXXXXXXXCXXCXXXXXTSGNLTEHXXXHXXXXXXXXXXX

SEQ ID NO: 2395 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKALTEHXXXHXXXXXXXCXXCXXXXXDPGHLVRHXXXHXXXXXXXCXXCXXXXXHTGHLLEHXXXHXXXXXXXCXXCXXXXXHTGHLLEHXXXHXXXXXXXCXXCXXXXXTSHSLTEHXXXHXXXXXXXCXXCXXXXXTKNSLTEHXXXHXXXXXXXCXXCXXXXXRNDALTEHXXXHXXXXXXXXXXX

SEQ ID NO: 2396 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRNDALTEHXXXHXXXXXXXCXXCXXXXXSKKALTEHXXXHXXXXXXXCXXCXXXXXDPGHLVRHXXXHXXXXXXXCXXCXXXXXHTGHLLEHXXXHXXXXXXXCXXCXXXXXHTGHLLEHXXXHXXXXXXXCXXCXXXXXTSHSLTEHXXXHXXXXXXXCXXCXXXXXTKNSLTEHXXXHXXXXXXXXXXX

SEQ ID NO: 2397 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKHLAEHXXXHXXXXXXXCXXCXXXXXRNDALTEHXXXHXXXXXXXCXXCXXXXXSKKALTEHXXXHXXXXXXXCXXCXXXXXDPGHLVRHXXXHXXXXXXXCXXCXXXXXHTGHLLEHXXXHXXXXXXXCXXCXXXXXHTGHLLEHXXXHXXXXXXXCXXCXXXXXTSHSLTEHXXXHXXXXXXXXXXX

SEQ ID NO: 2398 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTTHXXXHXXXXXXXCXXCXXXXXSKKHLAEHXXXHXXXXXXXCXXCXXXXXQNSTLTEHXXXHXXXXXXXCXXCXXXXXDCRDLARHXXXHXXXXXXXCXXCXXXXXTKNSLTEHXXXHXXXXXXXCXXCXXXXXTSHSLTEHXXXHXXXXXXXCXXCXXXXXRSDKLTEHXXXHXXXXXXXXXXX

SEQ ID NO: 2399 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQNSTLTEHXXXHXXXXXXXCXXCXXXXXDCRDLARHXXXHXXXXXXXCXXCXXXXXTKNSLTEHXXXHXXXXXXXCXXCXXXXXTSHSLTEHXXXHXXXXXXXCXXCXXXXXRSDKLTEHXXXHXXXXXXXCXXCXXXXXRNDTLTEHXXXHXXXXXXXCXXCXXXXXRTDTLRDHXXXHXXXXXXXXXXX

SEQ ID NO: 2400 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKHLAEHXXXHXXXXXXXCXXCXXXXXQNSTLTEHXXXHXXXXXXXCXXCXXXXXDCRDLARHXXXHXXXXXXXCXXCXXXXXTKNSLTEHXXXHXXXXXXXCXXCXXXXXTSHSLTEHXXXHXXXXXXXCXXCXXXXXRSDKLTEHXXXHXXXXXXXCXXCXXXXXRNDTLTEHXXXHXXXXXXXXXXX

SEQ ID NO: 2401 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDDLVRHXXXHXXXXXXXCXXCXXXXXRSDHLTTHXXXHXXXXXXXCXXCXXXXXSKKHLAEHXXXHXXXXXXXCXXCXXXXXQNSTLTEHXXXHXXXXXXXCXXCXXXXXDCRDLARHXXXHXXXXXXXCXXCXXXXXTKNSLTEHXXXHXXXXXXXCXXCXXXXXTSHSLTEHXXXHXXXXXXXXXXX

SEQ ID NO: 2402 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKHLAEHXXXHXXXXXXXCXXCXXXXXRSDDLVRHXXXHXXXXXXXCXXCXXXXXRSDHLTTHXXXHXXXXXXXCXXCXXXXXSKKHLAEHXXXHXXXXXXXCXXCXXXXXQNSTLTEHXXXHXXXXXXXCXXCXXXXXDCRDLARHXXXHXXXXXXXCXXCXXXXXTKNSLTEHXXXHXXXXXXXXXXX

SEQ ID NO: 2403 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDKKDLTRHXXXHXXXXXXXCXXCXXXXXSKKHLAEHXXXHXXXXXXXCXXCXXXXXRSDDLVRHXXXHXXXXXXXCXXCXXXXXRSDHLTTHXXXHXXXXXXXCXXCXXXXXSKKHLAEHXXXHXXXXXXXCXXCXXXXXQNSTLTEHXXXHXXXXXXXCXXCXXXXXDCRDLARHXXXHXXXXXXXXXXX

SEQ ID NO: 2404 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRKDNLKNHXXXHXXXXXXXCXXCXXXXXRNDTLTEHXXXHXXXXXXXCXXCXXXXXDKKDLTRHXXXHXXXXXXXCXXCXXXXXSKKHLAEHXXXHXXXXXXXCXXCXXXXXRSDDLVRHXXXHXXXXXXXCXXCXXXXXRSDHLTTHXXXHXXXXXXXCXXCXXXXXSKKHLAEHXXXHXXXXXXXXXXX

SEQ ID NO: 2405 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDCRDLARHXXXHXXXXXXXCXXCXXXXXRKDNLKNHXXXHXXXXXXXCXXCXXXXXRNDTLTEHXXXHXXXXXXXCXXCXXXXXDKKDLTRHXXXHXXXXXXXCXXCXXXXXSKKHLAEHXXXHXXXXXXXCXXCXXXXXRSDDLVRHXXXHXXXXXXXCXXCXXXXXRSDHLTTHXXXHXXXXXXXXXXX

SEQ ID NO: 2406 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRNDTLTEHXXXHXXXXXXXCXXCXXXXXDKKDLTRHXXXHXXXXXXXCXXCXXXXXSKKHLAEHXXXHXXXXXXXCXXCXXXXXRSDDLVRHXXXHXXXXXXXCXXCXXXXXRSDHLTTHXXXHXXXXXXXCXXCXXXXXSKKHLAEHXXXHXXXXXXXCXXCXXXXXQNSTLTEHXXXHXXXXXXXXXXX

SEQ ID NO: 2407 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDCRDLARHXXXHXXXXXXXCXXCXXXXXSKKHLAEHXXXHXXXXXXXCXXCXXXXXDCRDLARHXXXHXXXXXXXCXXCXXXXXRKDNLKNHXXXHXXXXXXXCXXCXXXXXRNDTLTEHXXXHXXXXXXXCXXCXXXXXDKKDLTRHXXXHXXXXXXXCXXCXXXXXSKKHLAEHXXXHXXXXXXXXXXX

SEQ ID NO: 2408 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKHLAEHXXXHXXXXXXXCXXCXXXXXDCRDLARHXXXHXXXXXXXCXXCXXXXXRKDNLKNHXXXHXXXXXXXCXXCXXXXXRNDTLTEHXXXHXXXXXXXCXXCXXXXXDKKDLTRHXXXHXXXXXXXCXXCXXXXXSKKHLAEHXXXHXXXXXXXCXXCXXXXXRSDDLVRHXXXHXXXXXXXXXXX

SEQ ID NO: 2409 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKHLAEHXXXHXXXXXXXCXXCXXXXXSKKALTEHXXXHXXXXXXXCXXCXXXXXDCRDLARHXXXHXXXXXXXCXXCXXXXXDPGHLVRHXXXHXXXXXXXCXXCXXXXXRNDALTEHXXXHXXXXXXXCXXCXXXXXDKKDLTRHXXXHXXXXXXXCXXCXXXXXTKNSLTEHXXXHXXXXXXXXXXX

SEQ ID NO: 2410 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGHLVRHXXXHXXXXXXXCXXCXXXXXQSSNLVRHXXXHXXXXXXXCXXCXXXXXSKKHLAEHXXXHXXXXXXXCXXCXXXXXSKKALTEHXXXHXXXXXXXCXXCXXXXXDCRDLARHXXXHXXXXXXXCXXCXXXXXDPGHLVRHXXXHXXXXXXXCXXCXXXXXRNDALTEHXXXHXXXXXXXXXXX

SEQ ID NO: 2411 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKHLAEHXXXHXXXXXXXCXXCXXXXXDPGHLVRHXXXHXXXXXXXCXXCXXXXXQSSNLVRHXXXHXXXXXXXCXXCXXXXXSKKHLAEHXXXHXXXXXXXCXXCXXXXXSKKALTEHXXXHXXXXXXXCXXCXXXXXDCRDLARHXXXHXXXXXXXCXXCXXXXXDPGHLVRHXXXHXXXXXXXXXXX

SEQ ID NO: 2412 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTKNSLTEHXXXHXXXXXXXCXXCXXXXXHTGHLLEHXXXHXXXXXXXCXXCXXXXXSKKHLAEHXXXHXXXXXXXCXXCXXXXXDPGHLVRHXXXHXXXXXXXCXXCXXXXXQSSNLVRHXXXHXXXXXXXCXXCXXXXXSKKHLAEHXXXHXXXXXXXCXXCXXXXXSKKALTEHXXXHXXXXXXXXXXX

SEQ ID NO: 2413 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXHTGHLLEHXXXHXXXXXXXCXXCXXXXXSKKHLAEHXXXHXXXXXXXCXXCXXXXXDPGHLVRHXXXHXXXXXXXCXXCXXXXXQSSNLVRHXXXHXXXXXXXCXXCXXXXXSKKHLAEHXXXHXXXXXXXCXXCXXXXXSKKALTEHXXXHXXXXXXXCXXCXXXXXDCRDLARHXXXHXXXXXXXXXXX

SEQ ID NO: 2414 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRNDTLTEHXXXHXXXXXXXCXXCXXXXXTKNSLTEHXXXHXXXXXXXCXXCXXXXXHTGHLLEHXXXHXXXXXXXCXXCXXXXXSKKHLAEHXXXHXXXXXXXCXXCXXXXXDPGHLVRHXXXHXXXXXXXCXXCXXXXXQSSNLVRHXXXHXXXXXXXCXXCXXXXXSKKHLAEHXXXHXXXXXXXXXXX

SEQ ID NO: 2415 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKHLAEHXXXHXXXXXXXCXXCXXXXXRNDTLTEHXXXHXXXXXXXCXXCXXXXXTKNSLTEHXXXHXXXXXXXCXXCXXXXXHTGHLLEHXXXHXXXXXXXCXXCXXXXXSKKHLAEHXXXHXXXXXXXCXXCXXXXXDPGHLVRHXXXHXXXXXXXCXXCXXXXXQSSNLVRHXXXHXXXXXXXXXXX

SEQ ID NO: 2416 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTNHXXXHXXXXXXXCXXCXXXXXQSGHLTEHXXXHXXXXXXXCXXCXXXXXSKKHLAEHXXXHXXXXXXXCXXCXXXXXTSHSLTEHXXXHXXXXXXXCXXCXXXXXHTGHLLEHXXXHXXXXXXXCXXCXXXXXRSDKLVRHXXXHXXXXXXXCXXCXXXXXTKNSLTEHXXXHXXXXXXXXXXX

SEQ ID NO: 2417 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKHLAEHXXXHXXXXXXXCXXCXXXXXRSDHLTNHXXXHXXXXXXXCXXCXXXXXQSGHLTEHXXXHXXXXXXXCXXCXXXXXSKKHLAEHXXXHXXXXXXXCXXCXXXXXTSHSLTEHXXXHXXXXXXXCXXCXXXXXHTGHLLEHXXXHXXXXXXXCXXCXXXXXRSDKLVRHXXXHXXXXXXXXXXX

SEQ ID NO: 2418 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRNDTLTEHXXXHXXXXXXXCXXCXXXXXSKKHLAEHXXXHXXXXXXXCXXCXXXXXRSDHLTNHXXXHXXXXXXXCXXCXXXXXQSGHLTEHXXXHXXXXXXXCXXCXXXXXSKKHLAEHXXXHXXXXXXXCXXCXXXXXTSHSLTEHXXXHXXXXXXXCXXCXXXXXHTGHLLEHXXXHXXXXXXXXXXX

SEQ ID NO: 2419 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKHLAEHXXXHXXXXXXXCXXCXXXXXRNDTLTEHXXXHXXXXXXXCXXCXXXXXSKKHLAEHXXXHXXXXXXXCXXCXXXXXRSDHLTNHXXXHXXXXXXXCXXCXXXXXQSGHLTEHXXXHXXXXXXXCXXCXXXXXSKKHLAEHXXXHXXXXXXXCXXCXXXXXTSHSLTEHXXXHXXXXXXXXXXX

SEQ ID NO: 2420 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDCRDLARHXXXHXXXXXXXCXXCXXXXXHRTTLTNHXXXHXXXXXXXCXXCXXXXXSKKHLAEHXXXHXXXXXXXCXXCXXXXXTKNSLTEHXXXHXXXXXXXCXXCXXXXXTKNSLTEHXXXHXXXXXXXCXXCXXXXXRNDALTEHXXXHXXXXXXXCXXCXXXXXTSHSLTEHXXXHXXXXXXXXXXX

SEQ ID NO: 2421 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGALVRHXXXHXXXXXXXCXXCXXXXXQRAHLERHXXXHXXXXXXXCXXCXXXXXRNDALTEHXXXHXXXXXXXCXXCXXXXXRNDALTEHXXXHXXXXXXXCXXCXXXXXTSGNLVRHXXXHXXXXXXXCXXCXXXXXQSSNLVRHXXXHXXXXXXXCXXCXXXXXRSDHLTTHXXXHXXXXXXXXXXX

SEQ ID NO: 2422 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDCRDLARHXXXHXXXXXXXCXXCXXXXXQNSTLTEHXXXHXXXXXXXCXXCXXXXXDPGHLVRHXXXHXXXXXXXCXXCXXXXXTTGALTEHXXXHXXXXXXXCXXCXXXXXHRTTLTNHXXXHXXXXXXXCXXCXXXXXRSDKLVRHXXXHXXXXXXXCXXCXXXXXTSGELVRHXXXHXXXXXXXXXXX

SEQ ID NO: 2423 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGHLVRHXXXHXXXXXXXCXXCXXXXXRSDHLTNHXXXHXXXXXXXCXXCXXXXXQAGHLASHXXXHXXXXXXXCXXCXXXXXRNDALTEHXXXHXXXXXXXCXXCXXXXXTKNSLTEHXXXHXXXXXXXCXXCXXXXXREDNLHTHXXXHXXXXXXXCXXCXXXXXDCRDLARHXXXHXXXXXXXXXXX

SEQ ID NO: 2424 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQRAHLERHXXXHXXXXXXXCXXCXXXXXTSGHLVRHXXXHXXXXXXXCXXCXXXXXRSDHLTNHXXXHXXXXXXXCXXCXXXXXQAGHLASHXXXHXXXXXXXCXXCXXXXXRNDALTEHXXXHXXXXXXXCXXCXXXXXTKNSLTEHXXXHXXXXXXXCXXCXXXXXREDNLHTHXXXHXXXXXXXXXXX

SEQ ID NO: 2425 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGHLVRHXXXHXXXXXXXCXXCXXXXXQRAHLERHXXXHXXXXXXXCXXCXXXXXTSGHLVRHXXXHXXXXXXXCXXCXXXXXRSDHLTNHXXXHXXXXXXXCXXCXXXXXQAGHLASHXXXHXXXXXXXCXXCXXXXXRNDALTEHXXXHXXXXXXXCXXCXXXXXTKNSLTEHXXXHXXXXXXXXXXX

SEQ ID NO: 2426 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXRNDTLTEHXXXHXXXXXXXCXXCXXXXXRNDALTEHXXXHXXXXXXXCXXCXXXXXTSGELVRHXXXHXXXXXXXCXXCXXXXXRSDNLVRHXXXHXXXXXXXCXXCXXXXXRSDELVRHXXXHXXXXXXXCXXCXXXXXRSDKLVRHXXXHXXXXXXXXXXX

SEQ ID NO: 2427 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTNHXXXHXXXXXXXCXXCXXXXXRSDKLVRHXXXHXXXXXXXCXXCXXXXXRNDTLTEHXXXHXXXXXXXCXXCXXXXXRNDALTEHXXXHXXXXXXXCXXCXXXXXTSGELVRHXXXHXXXXXXXCXXCXXXXXRSDNLVRHXXXHXXXXXXXCXXCXXXXXRSDELVRHXXXHXXXXXXXXXXX

SEQ ID NO: 2428 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGHLVRHXXXHXXXXXXXCXXCXXXXXRSDHLTNHXXXHXXXXXXXCXXCXXXXXRSDKLVRHXXXHXXXXXXXCXXCXXXXXRNDTLTEHXXXHXXXXXXXCXXCXXXXXRNDALTEHXXXHXXXXXXXCXXCXXXXXTSGELVRHXXXHXXXXXXXCXXCXXXXXRSDNLVRHXXXHXXXXXXXXXXX

SEQ ID NO: 2429 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXTSGHLVRHXXXHXXXXXXXCXXCXXXXXRSDHLTNHXXXHXXXXXXXCXXCXXXXXRSDKLVRHXXXHXXXXXXXCXXCXXXXXRNDTLTEHXXXHXXXXXXXCXXCXXXXXRNDALTEHXXXHXXXXXXXCXXCXXXXXTSGELVRHXXXHXXXXXXXXXXX

SEQ ID NO: 2430 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGHLVRHXXXHXXXXXXXCXXCXXXXXRSDKLVRHXXXHXXXXXXXCXXCXXXXXTSGHLVRHXXXHXXXXXXXCXXCXXXXXRSDHLTNHXXXHXXXXXXXCXXCXXXXXRSDKLVRHXXXHXXXXXXXCXXCXXXXXRNDTLTEHXXXHXXXXXXXCXXCXXXXXRNDALTEHXXXHXXXXXXXXXXX

SEQ ID NO: 2431 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTTGNLTVHXXXHXXXXXXXCXXCXXXXXTSGSLVRHXXXHXXXXXXXCXXCXXXXXRSDKLVRHXXXHXXXXXXXCXXCXXXXXRSDELVRHXXXHXXXXXXXCXXCXXXXXRSDKLVRHXXXHXXXXXXXCXXCXXXXXQRAHLERHXXXHXXXXXXXCXXCXXXXXRSDKLTEHXXXHXXXXXXXXXXX

SEQ ID NO: 2432 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTTHXXXHXXXXXXXCXXCXXXXXHKNALQNHXXXHXXXXXXXCXXCXXXXXRSDKLVRHXXXHXXXXXXXCXXCXXXXXQSGDLRRHXXXHXXXXXXXCXXCXXXXXTSGELVRHXXXHXXXXXXXCXXCXXXXXRSDKLVRHXXXHXXXXXXXCXXCXXXXXDPGHLVRHXXXHXXXXXXXXXXX

SEQ ID NO: 2433 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXHKNALQNHXXXHXXXXXXXCXXCXXXXXRSDKLVRHXXXHXXXXXXXCXXCXXXXXQSGDLRRHXXXHXXXXXXXCXXCXXXXXTSGELVRHXXXHXXXXXXXCXXCXXXXXRSDKLVRHXXXHXXXXXXXCXXCXXXXXDPGHLVRHXXXHXXXXXXXCXXCXXXXXRNDALTEHXXXHXXXXXXXXXXX

SEQ ID NO: 2434 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRNDALTEHXXXHXXXXXXXCXXCXXXXXRSDHLTTHXXXHXXXXXXXCXXCXXXXXHKNALQNHXXXHXXXXXXXCXXCXXXXXRSDKLVRHXXXHXXXXXXXCXXCXXXXXQSGDLRRHXXXHXXXXXXXCXXCXXXXXTSGELVRHXXXHXXXXXXXCXXCXXXXXRSDKLVRHXXXHXXXXXXXXXXX

SEQ ID NO: 2435 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGELVRHXXXHXXXXXXXCXXCXXXXXRSDKLVRHXXXHXXXXXXXCXXCXXXXXDPGHLVRHXXXHXXXXXXXCXXCXXXXXRNDALTEHXXXHXXXXXXXCXXCXXXXXRSDHLTNHXXXHXXXXXXXCXXCXXXXXTSGNLVRHXXXHXXXXXXXCXXCXXXXXRSDELVRHXXXHXXXXXXXXXXX

SEQ ID NO: 2436 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQSGDLRRHXXXHXXXXXXXCXXCXXXXXTSGELVRHXXXHXXXXXXXCXXCXXXXXRSDKLVRHXXXHXXXXXXXCXXCXXXXXDPGHLVRHXXXHXXXXXXXCXXCXXXXXRNDALTEHXXXHXXXXXXXCXXCXXXXXRSDHLTNHXXXHXXXXXXXCXXCXXXXXTSGNLVRHXXXHXXXXXXXXXXX

SEQ ID NO: 2437 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXDPGHLVRHXXXHXXXXXXXCXXCXXXXXRNDALTEHXXXHXXXXXXXCXXCXXXXXRSDHLTNHXXXHXXXXXXXCXXCXXXXXTSGNLVRHXXXHXXXXXXXCXXCXXXXXRSDELVRHXXXHXXXXXXXCXXCXXXXXRNDTLTEHXXXHXXXXXXXXXXX

SEQ ID NO: 2438 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGHLVRHXXXHXXXXXXXCXXCXXXXXRNDALTEHXXXHXXXXXXXCXXCXXXXXRSDHLTNHXXXHXXXXXXXCXXCXXXXXTSGNLVRHXXXHXXXXXXXCXXCXXXXXRSDELVRHXXXHXXXXXXXCXXCXXXXXRNDTLTEHXXXHXXXXXXXCXXCXXXXXRNDTLTEHXXXHXXXXXXXXXXX

SEQ ID NO: 2439 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRNDALTEHXXXHXXXXXXXCXXCXXXXXRSDHLTNHXXXHXXXXXXXCXXCXXXXXTSGNLVRHXXXHXXXXXXXCXXCXXXXXRSDELVRHXXXHXXXXXXXCXXCXXXXXRNDTLTEHXXXHXXXXXXXCXXCXXXXXRNDTLTEHXXXHXXXXXXXCXXCXXXXXSKKHLAEHXXXHXXXXXXXXXXX

SEQ ID NO: 2440 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTNHXXXHXXXXXXXCXXCXXXXXTSGNLVRHXXXHXXXXXXXCXXCXXXXXRSDELVRHXXXHXXXXXXXCXXCXXXXXRNDTLTEHXXXHXXXXXXXCXXCXXXXXRNDTLTEHXXXHXXXXXXXCXXCXXXXXSKKHLAEHXXXHXXXXXXXCXXCXXXXXTSGHLVRHXXXHXXXXXXXXXXX

SEQ ID NO: 2441 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRADNLTEHXXXHXXXXXXXCXXCXXXXXRNDALTEHXXXHXXXXXXXCXXCXXXXXRSDKLVRHXXXHXXXXXXXCXXCXXXXXRSDDLVRHXXXHXXXXXXXCXXCXXXXXRSDHLTTHXXXHXXXXXXXCXXCXXXXXDPGHLVRHXXXHXXXXXXXCXXCXXXXXQKSSLIAHXXXHXXXXXXXXXXX

SEQ ID NO: 2442 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXRSDDLVRHXXXHXXXXXXXCXXCXXXXXRSDHLTTHXXXHXXXXXXXCXXCXXXXXDPGHLVRHXXXHXXXXXXXCXXCXXXXXQKSSLIAHXXXHXXXXXXXCXXCXXXXXRSDHLTTHXXXHXXXXXXXCXXCXXXXXRSDKLTEHXXXHXXXXXXXXXXX

SEQ ID NO: 2443 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRNDALTEHXXXHXXXXXXXCXXCXXXXXRSDKLVRHXXXHXXXXXXXCXXCXXXXXRSDDLVRHXXXHXXXXXXXCXXCXXXXXRSDHLTTHXXXHXXXXXXXCXXCXXXXXDPGHLVRHXXXHXXXXXXXCXXCXXXXXQKSSLIAHXXXHXXXXXXXCXXCXXXXXRSDHLTTHXXXHXXXXXXXXXXX

SEQ ID NO: 2444 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDDLVRHXXXHXXXXXXXCXXCXXXXXRSDHLTTHXXXHXXXXXXXCXXCXXXXXDPGHLVRHXXXHXXXXXXXCXXCXXXXXQKSSLIAHXXXHXXXXXXXCXXCXXXXXRSDHLTTHXXXHXXXXXXXCXXCXXXXXRSDKLTEHXXXHXXXXXXXCXXCXXXXXHTGHLLEHXXXHXXXXXXXXXXX

SEQ ID NO: 2445 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGHLVRHXXXHXXXXXXXCXXCXXXXXQKSSLIAHXXXHXXXXXXXCXXCXXXXXRSDHLTTHXXXHXXXXXXXCXXCXXXXXRSDKLTEHXXXHXXXXXXXCXXCXXXXXHTGHLLEHXXXHXXXXXXXCXXCXXXXXSKKHLAEHXXXHXXXXXXXCXXCXXXXXDPGALVRHXXXHXXXXXXXXXXX

SEQ ID NO: 2446 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDHLTTHXXXHXXXXXXXCXXCXXXXXDPGHLVRHXXXHXXXXXXXCXXCXXXXXQKSSLIAHXXXHXXXXXXXCXXCXXXXXRSDHLTTHXXXHXXXXXXXCXXCXXXXXRSDKLTEHXXXHXXXXXXXCXXCXXXXXHTGHLLEHXXXHXXXXXXXCXXCXXXXXSKKHLAEHXXXHXXXXXXXXXXX

SEQ ID NO: 2447 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQRAHLERHXXXHXXXXXXXCXXCXXXXXRADNLTEHXXXHXXXXXXXCXXCXXXXXRNDALTEHXXXHXXXXXXXCXXCXXXXXRSDKLVRHXXXHXXXXXXXCXXCXXXXXRSDDLVRHXXXHXXXXXXXCXXCXXXXXRSDHLTTHXXXHXXXXXXXCXXCXXXXXDPGHLVRHXXXHXXXXXXXXXXX

SEQ ID NO: 2448 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDPGHLVRHXXXHXXXXXXXCXXCXXXXXRSDKLTEHXXXHXXXXXXXCXXCXXXXXRSDKLVRHXXXHXXXXXXXCXXCXXXXXTSGELVRHXXXHXXXXXXXCXXCXXXXXREDNLHTHXXXHXXXXXXXCXXCXXXXXQRAHLERHXXXHXXXXXXXCXXCXXXXXTSGHLVRHXXXHXXXXXXXXXXX

SEQ ID NO: 2449 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLTEHXXXHXXXXXXXCXXCXXXXXRSDKLVRHXXXHXXXXXXXCXXCXXXXXTSGELVRHXXXHXXXXXXXCXXCXXXXXREDNLHTHXXXHXXXXXXXCXXCXXXXXQRAHLERHXXXHXXXXXXXCXXCXXXXXTSGHLVRHXXXHXXXXXXXCXXCXXXXXDCRDLARHXXXHXXXXXXXXXXX

SEQ ID NO: 2450 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXTSGELVRHXXXHXXXXXXXCXXCXXXXXREDNLHTHXXXHXXXXXXXCXXCXXXXXQRAHLERHXXXHXXXXXXXCXXCXXXXXTSGHLVRHXXXHXXXXXXXCXXCXXXXXDCRDLARHXXXHXXXXXXXCXXCXXXXXSKKHLAEHXXXHXXXXXXXXXXX

SEQ ID NO: 2451 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTTGNLTVHXXXHXXXXXXXCXXCXXXXXTSGELVRHXXXHXXXXXXXCXXCXXXXXTSGHLVRHXXXHXXXXXXXCXXCXXXXXRSDKLTEHXXXHXXXXXXXCXXCXXXXXDKKDLTRHXXXHXXXXXXXCXXCXXXXXDPGNLVRHXXXHXXXXXXXCXXCXXXXXTSGELVRHXXXHXXXXXXXXXXX

SEQ ID NO: 2452 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGELVRHXXXHXXXXXXXCXXCXXXXXTSGHLVRHXXXHXXXXXXXCXXCXXXXXRSDKLTEHXXXHXXXXXXXCXXCXXXXXDKKDLTRHXXXHXXXXXXXCXXCXXXXXDPGNLVRHXXXHXXXXXXXCXXCXXXXXTSGELVRHXXXHXXXXXXXCXXCXXXXXRNDALTEHXXXHXXXXXXXXXXX

SEQ ID NO: 2453 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTHLDLIRHXXXHXXXXXXXCXXCXXXXXQNSTLTEHXXXHXXXXXXXCXXCXXXXXDCRDLARHXXXHXXXXXXXCXXCXXXXXRSDKLVRHXXXHXXXXXXXCXXCXXXXXTSGELVRHXXXHXXXXXXXCXXCXXXXXTHLDLIRHXXXHXXXXXXXCXXCXXXXXSPADLTRHXXXHXXXXXXXXXXX

SEQ ID NO: 2454 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXDCRDLARHXXXHXXXXXXXCXXCXXXXXRSDKLVRHXXXHXXXXXXXCXXCXXXXXTSGELVRHXXXHXXXXXXXCXXCXXXXXTHLDLIRHXXXHXXXXXXXCXXCXXXXXSPADLTRHXXXHXXXXXXXCXXCXXXXXHKNALQNHXXXHXXXXXXXCXXCXXXXXQNSTLTEHXXXHXXXXXXXXXXX

SEQ ID NO: 2455 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXQNSTLTEHXXXHXXXXXXXCXXCXXXXXDCRDLARHXXXHXXXXXXXCXXCXXXXXRSDKLVRHXXXHXXXXXXXCXXCXXXXXTSGELVRHXXXHXXXXXXXCXXCXXXXXTHLDLIRHXXXHXXXXXXXCXXCXXXXXSPADLTRHXXXHXXXXXXXCXXCXXXXXHKNALQNHXXXHXXXXXXXXXXX

SEQ ID NO: 2456 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXRSDKLVRHXXXHXXXXXXXCXXCXXXXXTSGELVRHXXXHXXXXXXXCXXCXXXXXTHLDLIRHXXXHXXXXXXXCXXCXXXXXSPADLTRHXXXHXXXXXXXCXXCXXXXXHKNALQNHXXXHXXXXXXXCXXCXXXXXQNSTLTEHXXXHXXXXXXXCXXCXXXXXRSDELVRHXXXHXXXXXXXXXXX

SEQ ID NO: 2457 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXTSGELVRHXXXHXXXXXXXCXXCXXXXXTHLDLIRHXXXHXXXXXXXCXXCXXXXXSPADLTRHXXXHXXXXXXXCXXCXXXXXHKNALQNHXXXHXXXXXXXCXXCXXXXXQNSTLTEHXXXHXXXXXXXCXXCXXXXXRSDELVRHXXXHXXXXXXXCXXCXXXXXRSDKLVRHXXXHXXXXXXXXXXX

SEQ ID NO: 2458 - protein, 209 aa, Artificial Sequence
  source: /note="Description of Artificial Sequence: Synthetic polypeptide"
  MOD_RES (1)..(9): Any amino acid
  MOD_RES (11)..(12): Any amino acid
  MOD_RES (14)..(18): Any amino acid
  MOD_RES (27)..(29): Any amino acid
  MOD_RES (31)..(37): Any amino acid
  MOD_RES (39)..(40): Any amino acid
  MOD_RES (42)..(46): Any amino acid
  MOD_RES (55)..(57): Any amino acid
  MOD_RES (59)..(65): Any amino acid
  MOD_RES (67)..(68): Any amino acid
  MOD_RES (70)..(74): Any amino acid
  MOD_RES (83)..(85): Any amino acid
  MOD_RES (87)..(93): Any amino acid
  MOD_RES (95)..(96): Any amino acid
  MOD_RES (98)..(102): Any amino acid
  MOD_RES (111)..(113): Any amino acid
  MOD_RES (115)..(121): Any amino acid
  MOD_RES (123)..(124): Any amino acid
  MOD_RES (126)..(130): Any amino acid
  MOD_RES (139)..(141): Any amino acid
  MOD_RES (143)..(149): Any amino acid
  MOD_RES (151)..(152): Any amino acid
  MOD_RES (154)..(158): Any amino acid
  MOD_RES (167)..(169): Any amino acid
  MOD_RES (171)..(177): Any amino acid
  MOD_RES (179)..(180): Any amino acid
  MOD_RES (182)..(186): Any amino acid
  MOD_RES (195)..(197): Any amino acid
  MOD_RES (199)..(209): Any amino acid
XXXXXXXXXCXXCXXXXXSKKALTEHXXXHXXXXXXXCXXCXXXXXTHLDLIRHXXXHXXXXXXXCXXCXXXXXQNSTLTEHXXXHXXXXXXXCXXCXXXXXDCRDLARHXXXHXXXXXXXCXXCXXXXXRSDKLVRHXXXHXXXXXXXCXXCXXXXXTSGELVRHXXXHXXXXXXXCXXCXXXXXTHLDLIRHXXXHXXXXXXXXXXX

(The sequence listing continues in the following parts.)

We claim:

1. A site-specific hepatocyte nuclear factor 4a (HNF4α) disrupting agent, comprising a site-specific HNF4α targeting moiety which targets an HNF4α expression control region, and wherein the HNF4α targeting moiety comprises a DNA-binding domain of a zinc finger (ZNF) polypeptide, or fragment thereof, that specifically binds to the HNF4α expression control region, wherein the DNA-binding domain of the ZNF polypeptide comprises an amino acid sequence having at least 85% amino acid identity to the entire amino acid sequence of any one of the amino acid sequences selected from the group consisting of SEQ ID NOs: 103, 107, 111, 115, 119, 123, 127, 131, 135, 139, 143, 147, 151, 155, and 159.

2. The site-specific HNF4α disrupting agent of claim 1, wherein the site-specific HNF4α disrupting agent is present in a composition.

3. A method of modulating expression of hepatocyte nuclear factor 4 alpha (HNF4α) in a cell, the method comprising contacting the cell with a site-specific HNF4α disrupting agent of claim 1, thereby modulating expression of HNF4α in the cell.

4. The method of claim 3, wherein the cell is within a subject, wherein the subject has an HNF4α-associated disease.

5. The method of claim 4, wherein the HNF4α-associated disease is selected from the group consisting of fatty liver (steatosis), nonalcoholic steatohepatitis (NASH), cirrhosis of the liver, accumulation of fat in the liver, inflammation of the liver, hepatocellular necrosis, liver fibrosis, and nonalcoholic fatty liver disease (NAFLD), polycystic kidney disease, inflammatory bowel disease (IBD), and MODY I.

6. A method for treating a subject having an HNF4α-associated disease, comprising administering to the subject a therapeutically effective amount of the site-specific HNF4α disrupting agent of claim 1, thereby treating the subject.

7. The method of claim 6, wherein the HNF4α-associated disease is selected from the group consisting of fatty liver (steatosis), nonalcoholic steatohepatitis (NASH), cirrhosis of the liver, accumulation of fat in the liver, inflammation of the liver, hepatocellular necrosis, liver fibrosis, and nonalcoholic fatty liver disease (NAFLD) and the site-specific HNF4α disrupting agent enhances expression of HNF4α in the subject.

8. The site-specific HNF4α disrupting agent of claim 1, wherein the HNF4α expression control region comprises the nucleotide sequence of SEQ ID NO:118.

9. The site-specific HNF4α disrupting agent of claim 1, wherein the HNF4α expression control region comprises the nucleotide sequence of SEQ ID NO:126.

10. The site-specific HNF4α disrupting agent of claim 1, wherein the DNA-binding domain of the ZNF polypeptide comprises an amino acid sequence having at least 85% amino acid identity to the amino acid sequence of SEQ ID NO: 119.

11. The site-specific HNF4α disrupting agent of claim 1, wherein the DNA-binding domain of the ZNF polypeptide comprises an amino acid sequence having at least 85% amino acid identity to the amino acid sequence of SEQ ID NO: 127.

12. The site-specific HNF4α disrupting agent of claim 1, wherein the agent further comprises an effector molecule, and wherein the effector molecule is fused to the DNA-binding domain of the ZNF polypeptide.

13. The site-specific HNF4α disrupting agent of claim 12, wherein the effector molecule is selected from the group consisting of a physical blocker, an epigenetic recruiter, and an epigenetic CpG modifier.

14. The site-specific HNF4α disrupting agent of claim 13, wherein the epigenetic recruiter is selected from the group consisting of a transcriptional enhancer and a transcriptional repressor.

15. The site-specific HNF4α disrupting agent of claim 13, wherein the CpG modifier is selected from the group consisting of a DNA methylase, a DNA demethylase, a histone modifying agent, and a histone deacetylase.

16. The site-specific HNF4α disrupting agent of claim 12, wherein the effector molecule is VPR (VP64-p65-Rta).

17. The site-specific HNF4α disrupting agent of claim 16, wherein the VPR comprises an amino acid sequence having at least 85% amino acid identity to the amino acid sequence of SEQ ID NO: 66, and wherein the DNA-binding domain of the ZNF polypeptide comprises an amino acid sequence having at least 85% amino acid identity to the amino acid sequence of SEQ ID NO: 119.

18. The site-specific HNF4α disrupting agent of claim 12, wherein the effector molecule is P300.

19. The site-specific HNF4α disrupting agent of claim 18, wherein the P300 comprises an amino acid sequence having at least 85% amino acid identity to the amino acid sequence of SEQ ID NO: 67, and wherein the DNA-binding domain of the ZNF polypeptide comprises an amino acid sequence having at least 85% amino acid identity to the amino acid sequence of SEQ ID NO: 127.

20. The site-specific HNF4α disrupting agent of claim 1, wherein the DNA-binding domain of the ZNF polypeptide comprises an amino acid sequence having at least 90% amino acid identity to the entire amino acid sequence of any one of the amino acid sequences selected from the group consisting of SEQ ID NOs: 103, 107, 111, 115, 119, 123, 127, 131, 135, 139, 143, 147, 151, 155, and 159.

21. The site-specific HNF4α disrupting agent of claim 1, wherein the DNA-binding domain of the ZNF polypeptide comprises an amino acid sequence having at least 95% amino acid identity to the entire amino acid sequence of any one of the amino acid sequences selected from the group consisting of SEQ ID NOs: 103, 107, 111, 115, 119, 123, 127, 131, 135, 139, 143, 147, 151, 155, and 159.

22. The site-specific HNF4α disrupting agent of claim 20, wherein the DNA-binding domain of the ZNF polypeptide comprises an amino acid sequence having at least 90% amino acid identity to the amino acid sequence of SEQ ID NO: 119.

23. The site-specific HNF4α disrupting agent of claim 21, wherein the DNA-binding domain of the ZNF polypeptide comprises an amino acid sequence having at least 95% amino acid identity to the amino acid sequence of SEQ ID NO: 119.

24. The site-specific HNF4α disrupting agent of claim 1, wherein the DNA-binding domain of the ZNF polypeptide comprises the amino acid sequence of SEQ ID NO: 119.

25. The site-specific HNF4α disrupting agent of claim 20, wherein the DNA-binding domain of the ZNF polypeptide comprises an amino acid sequence having at least 90% amino acid identity to the amino acid sequence of SEQ ID NO: 127.

26. The site-specific HNF4α disrupting agent of claim 21, wherein the DNA-binding domain of the ZNF polypeptide comprises an amino acid sequence having at least 95% amino acid identity to the amino acid sequence of SEQ ID NO: 127.

27. The site-specific HNF4α disrupting agent of claim 1, wherein the DNA-binding domain of the ZNF polypeptide comprises the amino acid sequence of SEQ ID NO: 127.

28. The site-specific HNF4α disrupting agent of claim 16, wherein the VPR comprises the amino acid sequence of SEQ ID NO: 66.

29. The site-specific HNF4α disrupting agent of claim 16, wherein the VPR comprises an amino acid sequence having at least 90% amino acid identity to the amino acid sequence of SEQ ID NO: 66, and wherein the DNA-binding domain of the ZNF polypeptide comprises an amino acid sequence having at least 90% amino acid identity to the amino acid sequence of SEQ ID NO: 119.

30. The site-specific HNF4α disrupting agent of claim 16, wherein the VPR comprises an amino acid sequence having at least 95% amino acid identity to the amino acid sequence of SEQ ID NO: 66, and wherein the DNA-binding domain of the ZNF polypeptide comprises an amino acid sequence having at least 95% amino acid identity to the amino acid sequence of SEQ ID NO: 119.

31. The site-specific HNF4α disrupting agent of claim 16, wherein the VPR comprises the amino acid sequence of SEQ ID NO: 66, and wherein the DNA-binding domain of the ZNF polypeptide comprises the amino acid sequence of SEQ ID NO: 119.

32. The site-specific HNF4α disrupting agent of claim 18, wherein the P300 comprises the amino acid sequence of SEQ ID NO: 67.

33. The site-specific HNF4α disrupting agent of claim 18, wherein the P300 comprises an amino acid sequence having at least 90% amino acid identity to the amino acid sequence of SEQ ID NO: 67, and wherein the DNA-binding domain of the ZNF polypeptide comprises an amino acid sequence having at least 90% amino acid identity to the amino acid sequence of SEQ ID NO: 127.

34. The site-specific HNF4α disrupting agent of claim 18, wherein the P300 comprises an amino acid sequence having at least 95% amino acid identity to the amino acid sequence of SEQ ID NO: 67, and wherein the DNA-binding domain of the ZNF polypeptide comprises an amino acid sequence having at least 95% amino acid identity to the amino acid sequence of SEQ ID NO: 127.

35. The site-specific HNF4α disrupting agent of claim 18, wherein the P300 comprises the amino acid sequence of SEQ ID NO: 67, and wherein the DNA-binding domain of the ZNF polypeptide comprises the amino acid sequence of SEQ ID NO: 127.

36. The site-specific HNF4α disrupting agent of claim 16, wherein the site-specific HNF4α disrupting agent comprises an amino acid sequence having at least 90% amino acid identity to the entire amino acid sequence of SEQ ID NO:116.

37. The site-specific HNF4α disrupting agent of claim 16, wherein the site-specific HNF4α disrupting agent comprises an amino acid sequence having at least 95% amino acid identity to the entire amino acid sequence of SEQ ID NO:116.

* * * * *